United States Patent 7,745,391 (HUMAN THROMBOSPONDIN POLYPEPTIDE) - sequence listing, part 256

SEQ ID NO: 732935 - DNA, 740 bp, Homo sapiens
  misc_feature (697)..(697): n is a, c, g, or t
  misc_feature (700)..(700): n is a, c, g, or t
  misc_feature (706)..(706): n is a, c, g, or t
  misc_feature (709)..(709): n is a, c, g, or t
tagctcggcccggttgcaactgaacaccggctctgaggcagcattctcccccagtttttcagccgtaattagtacaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732936 - DNA, 1371 bp, Homo sapiens
  misc_feature (1328)..(1328): n is a, c, g, or t
  misc_feature (1331)..(1331): n is a, c, g, or t
  misc_feature (1337)..(1337): n is a, c, g, or t
  misc_feature (1340)..(1340): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagcacagcccctctttactgatgagaaaactgaggctcagagagattgcctgatatacctgaagtcccacaataagggctgcacatgggatagaaactcacttcctacacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732937 - DNA, 1013 bp, Homo sapiens
  misc_feature (970)..(970): n is a, c, g, or t
  misc_feature (973)..(973): n is a, c, g, or t
  misc_feature (979)..(979): n is a, c, g, or t
  misc_feature (982)..(982): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggcatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732938 - DNA, 1143 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (1100)..(1100): n is a, c, g, or t
  misc_feature (1103)..(1103): n is a, c, g, or t
  misc_feature (1109)..(1109): n is a, c, g, or t
  misc_feature (1112)..(1112): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732939 - DNA, 1350 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (1307)..(1307): n is a, c, g, or t
  misc_feature (1310)..(1310): n is a, c, g, or t
  misc_feature (1316)..(1316): n is a, c, g, or t
  misc_feature (1319)..(1319): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732940 - DNA, 1328 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (1285)..(1285): n is a, c, g, or t
  misc_feature (1288)..(1288): n is a, c, g, or t
  misc_feature (1294)..(1294): n is a, c, g, or t
  misc_feature (1297)..(1297): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732941 - DNA, 1121 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (1078)..(1078): n is a, c, g, or t
  misc_feature (1081)..(1081): n is a, c, g, or t
  misc_feature (1087)..(1087): n is a, c, g, or t
  misc_feature (1090)..(1090): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732942 - DNA, 985 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (942)..(942): n is a, c, g, or t
  misc_feature (945)..(945): n is a, c, g, or t
  misc_feature (951)..(951): n is a, c, g, or t
  misc_feature (954)..(954): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732943 - DNA, 1143 bp, Homo sapiens; identical to SEQ ID NO: 732938
  misc_feature (1)..(1): n is a, c, g, or t
  misc_feature (28)..(28): n is a, c, g, or t
  misc_feature (33)..(33): n is a, c, g, or t
  misc_feature (1100)..(1100): n is a, c, g, or t
  misc_feature (1103)..(1103): n is a, c, g, or t
  misc_feature (1109)..(1109): n is a, c, g, or t
  misc_feature (1112)..(1112): n is a, c, g, or t

SEQ ID NO: 732944 - DNA, 1350 bp, Homo sapiens; identical to SEQ ID NO: 732939
  misc_feature (1)..(1): n is a, c, g, or t
  misc_feature (28)..(28): n is a, c, g, or t
  misc_feature (33)..(33): n is a, c, g, or t
  misc_feature (1307)..(1307): n is a, c, g, or t
  misc_feature (1310)..(1310): n is a, c, g, or t
  misc_feature (1316)..(1316): n is a, c, g, or t
  misc_feature (1319)..(1319): n is a, c, g, or t

SEQ ID NO: 732945 - DNA, 1143 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (685)..(685): n is a, c, g, or t
  misc_feature (1100)..(1100): n is a, c, g, or t
  misc_feature (1103)..(1103): n is a, c, g, or t
  misc_feature (1109)..(1109): n is a, c, g, or t
  misc_feature (1112)..(1112): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactaganaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732946 - DNA, 881 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (856)..(856): n is a, c, g, or t
  misc_feature (872)..(872): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcacccttttttgggcgaggttgccgttttatntacattttagggacgntttccggtt

SEQ ID NO: 732947 - DNA, 1464 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (1421)..(1421): n is a, c, g, or t
  misc_feature (1424)..(1424): n is a, c, g, or t
  misc_feature (1430)..(1430): n is a, c, g, or t
  misc_feature (1433)..(1433): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagcacagcccctctttactgatgagaaaactgaggctcagagagattgcctgatatacctgaagtcccacaataagggctgcacatgggatagaaactcacttcctacacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732948 - DNA, 1041 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (998)..(998): n is a, c, g, or t
  misc_feature (1001)..(1001): n is a, c, g, or t
  misc_feature (1007)..(1007): n is a, c, g, or t
  misc_feature (1010)..(1010): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacaggccaagcccgcagtgcctacgtctaagctggtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732949 - DNA, 576 bp, Homo sapiens
  misc_feature (1)..(1): n is a, c, g, or t
  misc_feature (28)..(28): n is a, c, g, or t
  misc_feature (33)..(33): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccgcgatcgaagtgtgggagccggct

SEQ ID NO: 732950 - DNA, 1106 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (1063)..(1063): n is a, c, g, or t
  misc_feature (1066)..(1066): n is a, c, g, or t
  misc_feature (1072)..(1072): n is a, c, g, or t
  misc_feature (1075)..(1075): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggcatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732951 - DNA, 1206 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (1163)..(1163): n is a, c, g, or t
  misc_feature (1166)..(1166): n is a, c, g, or t
  misc_feature (1172)..(1172): n is a, c, g, or t
  misc_feature (1175)..(1175): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732952 - DNA, 1119 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (1076)..(1076): n is a, c, g, or t
  misc_feature (1079)..(1079): n is a, c, g, or t
  misc_feature (1085)..(1085): n is a, c, g, or t
  misc_feature (1088)..(1088): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732953 - DNA, 1326 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (1283)..(1283): n is a, c, g, or t
  misc_feature (1286)..(1286): n is a, c, g, or t
  misc_feature (1292)..(1292): n is a, c, g, or t
  misc_feature (1295)..(1295): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732954 - DNA, 1108 bp, Homo sapiens
  misc_feature (1)..(1): n is a, c, g, or t
  misc_feature (28)..(28): n is a, c, g, or t
  misc_feature (33)..(33): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtggaagccccaacgggaaaggaaacgccccgggcaaagggtcttttgcagcttttgcagacgggcaagaagctgcttctgcccacaccgcagggacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggggcggtcttataattagagctcccgtgagcaggtcagtggaaacccagggattccgccaaacggataagcctgtgaaacaaaaaagaaaaaaaaaattggctcgcgcgaaattaacattgggcggcccaaaaaaatggagcccaaacgggaaggggtccacaagcggggggaaaaagtgtggtaacccaaccccggg

SEQ ID NO: 732955 - DNA, 673 bp, Homo sapiens
  misc_feature (630)..(630): n is a, c, g, or t
  misc_feature (633)..(633): n is a, c, g, or t
  misc_feature (639)..(639): n is a, c, g, or t
  misc_feature (642)..(642): n is a, c, g, or t
ctatcttcatgatgtagcagcaggtcgcaggggctggcttgtaggcgcatcagagtgctggtagtcatacaccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732956 - DNA, 880 bp, Homo sapiens
  misc_feature (837)..(837): n is a, c, g, or t
  misc_feature (840)..(840): n is a, c, g, or t
  misc_feature (846)..(846): n is a, c, g, or t
  misc_feature (849)..(849): n is a, c, g, or t
ctatcttcatgatgtagcagcaggtcgcaggggctggcttgtaggcgcatcagagtgctggtagtcatacaccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732957 - DNA, 1350 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (685)..(685): n is a, c, g, or t
  misc_feature (1307)..(1307): n is a, c, g, or t
  misc_feature (1310)..(1310): n is a, c, g, or t
  misc_feature (1316)..(1316): n is a, c, g, or t
  misc_feature (1319)..(1319): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactaganaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgaattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732958 - DNA, 651 bp, Homo sapiens
  misc_feature (608)..(608): n is a, c, g, or t
  misc_feature (611)..(611): n is a, c, g, or t
  misc_feature (617)..(617): n is a, c, g, or t
  misc_feature (620)..(620): n is a, c, g, or t
ctatcttcatgatgtagcagcaggtcgcaggggctggcttgtaggcgcatcagagtgctggtagtcatacaccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaanaanaaacanaanacgtgcgggagctggcaccgaagatcaagac

SEQ ID NO: 732959 - DNA, 673 bp, Homo sapiens; identical to SEQ ID NO: 732955
  misc_feature (630)..(630): n is a, c, g, or t
  misc_feature (633)..(633): n is a, c, g, or t
  misc_feature (639)..(639): n is a, c, g, or t
  misc_feature (642)..(642): n is a, c, g, or t

SEQ ID NO: 732960 - DNA, 880 bp, Homo sapiens; identical to SEQ ID NO: 732956
  misc_feature (837)..(837): n is a, c, g, or t
  misc_feature (840)..(840): n is a, c, g, or t
  misc_feature (846)..(846): n is a, c, g, or t
  misc_feature (849)..(849): n is a, c, g, or t

SEQ ID NO: 732961 - DNA, 8001 bp, Homo sapiens
tgtcgattgtgtatggctgatgggattctaggaccaagcaagaggttttttttttttcccccacatacttaacgtttctatatttctatttgaattcgactggacagttccatttgaattatttctctctctctctctctctctctgacacattttatcttgccaggttctaaacctttaggaaaaatggagcaatttccaaaggaaaccgttgtggagagcagtgggccaaaggttttggaaacagcagaagagatccaggagaggcgtcaggaagtgttgactcggtatcaaagtttcaaggagcgggttgctgagaggggtcagaagcttgaggattcctatcacttacaagttttcaagcgagatgcagatgatctggggaagtggatcatggagaaagtcaatatcttaaccgataagagctatgaagacccaactaatatacaggggaaatatcagaagcatcaatcccttgaagcagaggtgcaaacgaaatcaagactcatgtctgaactggaaaaaacaagggaagaacgatttaccatgggtcattctgcccacgaagaaacgaaggcccatatagaggagctacgccacctgtgggacctgctgttagagctgaccctggagaagggtgaccagttgctgcgggccctgaagttccagcagtatgtacaggagtgtgctgacatcttagagtggattggagacaaggaggctatagcgacatcagtggagctaggtgaagactgggagcgcaccgaagttctgcataagaaatttgaagacttccaagtggagctggtagctaaagaagggagagttgttgaagtgaaccaatatgccaatgagtgtgccgaggaaaaccatcctgacctacccttaattcagtctaagcaaaatgaggtgaatgctgcctgggagcgccttcgtggtttggctctccagagacagaaagctctgtccaatgctgcaaacttacaacgattcaaaagggatgtgactgaagccatccagtggatcaaggagaaggaacctgtactcacctctgaggactatggcaaagaccttgttgcctctgaaggactgtttcacagccacaagggacttgagagaaatcttgcagtcatgagtgacaaggtgaaggagttatgtgctaaagcagagaagctgacactttcccatccttcagatgcacctcagatccaggagatgaaagaagatctggtctccagctgggagcatattcgtgccctggccaccagcagatatgaaaaactgcaggctacttattggtaccatcgattttcatctgactttgatgaactctcaggctggatgaacgagaagactgctgcgatcaatgctgatgagctgccaacagatgtggctggtggagaagttctgctggacaggcatcagcagcataagcatgagattgactcttacgatgaccgatttcaatctgctgatgagactggtcaagacctcgtgaatgccaatcatgaagcctctgatgaagttcgggaaaagatggaaatacttgacaacaactggactgccctgctggaactgtgggacgagcgtcatcgtcagtatgagcagtgcttggactttcatctcttctacagagacagtgagcaagtggacagttggatgagtagacaagaggccttcctggaaaacgaggatctgggaaactcactgggcagtgcagaagcccttcttcagaagcatgaagactttgaggaagcctttactgcccaggaagagaagatcataactgtagacaagactgcaaccaaattgattggtgatgaccattatgattcagagaacatcaaggctatccgtgacggcctgttagcccggcgggatgccctacgtgaaaaggctgccactagacgtagattgctgaaggagtcattgcttctgcaaaaactgtatgaggactcagatgacctaaagaactggatcaacaagaagaaaaagttggcagatgatgaagattacaaggacatacagaacttgaagagcagggttcaaaagcagcaagtctttgaaaaggagttggcagttaataagacccagctggaaaacatacagaaaactggccaagagatgattgagggtggtcactatgcctctgacaatgtgaccactcgtctgagtgaagttgccagcctctgggaggagttgctggaggctacaaaacagaaagggacccagttgcatgaggccaaccagcagctgcaatttgaaaataatgcagaagatttgcagcgctggctggaggatgttgagtggcaagtcacctctgaggattatgggaaaggcctggccgaggtacagaatcgactcaggaaacacggcctcctggagtcggctgtggctgctcgtcaggatcaggtggatatccttacagacctggctgcatattttgaagaaataggccatcctgattctaaggatataagggcaaggcaagagtccttggtatgccgatttgaagctctgaaagagccactggccaccagaaagaagaagctcttagaacttctccatctgcagctgatttgtagagacacagaggatgaggaagcctggatccaagagactgaaccctcagctacttccacctaccttggaaaggacctgattgcttccaaaaagcttctgaataggcatagagtcatcctggacaacattgccagccatgaaccacgcattcaagagataacagaaaggggaaacaaaatggtagaggaaggacactttgctgcagaagatgtggcctctagggtcaagagtttgaaccagaatatggagtctctccgtgctcgagctgctaggcgacaaaatgatcttgaagccaatgtccagttccagcagtacctggctgacctgcatgaagcagaaacatggatcagagagaaggaacctattgtagataatactaactatggtgctgatgaagaagcagctggggctcttctaaagaagcatgaggcctttctattagatctcaattcatttggagacagtatgaaagctctgcggaatcaggcaaacgcctgccagcaacaacaggctgcaccagtggagggagttgctggagaacaaagggtcatggctttatatgacttccaggcccgcagcccccgagaagtcaccatgaagaaaggtgatgtcttaacgctgctcagttccatcaataaggactggtggaaggtggaagctgctgatcatcagggcattgtcccagctgtctatgtcagaagactggcccacgatgagttcccgatgctcccacagcggcgacgagaagagccaggaaacatcacccagcgccaggagcagattgagaaccaataccgctccctcttggatcgggcagaagaacgcagacgtcgtctattgcaacgttataatgaatttttattggcctatgaggcaggagacatgctggaatggattcaagagaaaaaggcagaaaacactggagtggaactagatgatgtttgggagctgcagaaaaagtttgatgagttccaaaaggatttgaataccaatgagcctcggctaagggatatcaacaaggtagctgatgatctactatttgaaggacttctaacaccagaaggagctcaaatccggcaggaattgaatgcccgctggggttctttgcagaggcttgcagatgaacagcggcagctgctgggcagtgcccatgctgttgaagtgtttcacagagaagcagatgacacgaaggagcagattgagaagaaatgccaggccctcagtgctgcagaccctggctcagatctgttcagtgttcaggctcttcagcgacggcatgagggctttgaaagggacctcgtacccctgggagataaggtgaccatactgggggagacagcagagcggctcagtgagtcccatccagatgccactgaggacctgcagagacagaaaatggagctgaatgaggcctgggaagacctgcaggggcgtacaaaggatcgtaaggagagcctaaatgaggcccagaaattctacctgttcctcagcaaggccagggatctgcagaactggatcagtagcattggtggcatggtatcatcacaggagctggccgaagacttaactggcatagagatcttgctggagagacatcaggagcaccgtgctgacatggaggcagaggctcccaccttccaggccttagaggacttcagtgcagaacttatcgacagtgggcaccatgctagccctgaaattgaaaaaaagcttcaagctgtcaagctagagagagatgatttggagaaggcttgggaaaaacgcaagaagatcctagaccagtgcctggagttgcagatgttccaggggaactgtgatcaagttgagagccggatggtggcacgtgagaattccctgaggtcagatgacaaaagttccttagacagtctggaggctttgatgaagaaacgggacgatttggacaaagcaatcactgcccaggaagggaagatcactgacctagaacattttgctgagagcctcattgctgatgaacactatgccaaagaagagattgctacgcggctccaacgtgtactagacaggtggaaggctctcaaagcacaactgattgatgagcggacaaagcttggagactatgccaacctaaaacaattctaccgagaccttgaggagctggaagaatggatcagtgagatgctgcccacagcctgtgatgaatcctacaaagacgccactaacattcagaggaaatacctgaaacaccagacctttgcacatgaagtcgatggccgatctgagcaggtgcatggcgtcatcaacctggggaactccctgattgagcgtagttgtgatggcaatgaagaggccatgaaggagcaactggaacagctgaaggaacattgggatcatctgcttgagagaacaaatgacaaagggaagaagctcaatgaggccagtcgtcaacagaggttcaacacaagcatccgggactttgagttctggctctcagaggcagagacattgctggccatgaaagatcaggccagggacttggcttcagcaggaaacctactcaagaagcatcagctattggagagagagatgttggctcgagaggatgcactcaaggacctgaatacattggctgaagatttgctctccagcgggactttcaacgttgatcagattgtgaagaaaaaagataatgtcaacaagcgtttcctgaatgtccaagaattggcagctgcacaccacgaaaaattgaaagaggcctatgccttgttccagttcttccaggatctagatgatgaggaatcctggatagaggagaagttgatacgagtgagctcccaggactatgggagagatcttcagggggttcagaacttgctgaagaagcacaaacgcctagagggggagctggtggcccatgagcctgccatccagaatgtgctggatatggcagagaagctgaaagacaaggctgctgtggggcaagaggagatccagttgcggctggctcagtttgttgaacactgggagaagctcaaagagttggccaaggcccgaggacttaagttggaagaatccctagaatacttgcaattcatgcagaatgctgaggaagaggaagcttggatcaatgaaaagaatgctttggctgtccgaggagattgtggagatacattagctgctactcagagcttgctaatgaagcatgaagctttggaaaatgactttgctgtccatgagacccgagtacaaaatgtgtgtgcacaaggagaagacatcctaaataaggtgttgcaggaggaaagtcagaacaaagagatttcttccaagatagaggctctgaatgaaaagaccccttctctggctaaggcaatagctgcttggaagttgcaattggaagacgattatgcctttcaggaattcaactggaaggctgatgtggtagaggcttggatagctgataaggaaacaagcctaaagaccaatggcaatggtgcagaccttggtgacttcctcactcttctggcaaaacaggacactctggatgccagtctgcagagtttccagcaagagagacttcccgagatcactgacctgaaggacaaactgatttctgctcaacacaaccagtctaaagccattgaagagcgttatgccgctctgctgaagcgctgggaacagttgctggaagcctcggcagtccacagacagaaattgctggagaaacagctgcctctacagaaggctgaggacctgttcgtggaatttgcacataaggcttcagctttgaacaactggtgtgaaaagatggaagaaaacttgtcagagcctgtgcactgtgtctccctgaatgaaattcggcagctgcagaaagaccatgaggacttcttggcctccctggctagggctcaagcagactttaaatgtttgctggagctagaccagcagattaaggccttaggtgtgccttccagcccttatacctggttaacagtggaggtgctggaaaggacctggaagcacctatctgacatcattgaggaacgggagcaggagctgcaaaaggaagaggcaagacaggtcaagaactttgagatgtgtcaggagtttgaacagaatgccagtaccttccttcaatggatcctggaaaccagggcttactttctggatggatcattgctcaaagaaacaggaactctggaatctcagctggaagcaaataaaagaaaacagaaggagatccaggcgatgaagcgtcaactaaccaagattgtggacctgggggacaacttggaagacgctctgatccttgatatcaaatacagcaccattggattggctcagcagtgggaccagctctaccagcttgggttgcggatgcaacacaacctggagcaacagatccaggccaaggacatcaaaggtgtgagtgaagagactctaaaggaatttagcacaatctataaacactttgatgagaatttgacagggcgcctgactcacaaagagttccggtcctgcctgagaggactcaattactacttgcccatggtggaggaggatgaacatgagcccaagtttgagaagttcctggatgctgtggatccagggaggaagggctatgtctcactggaggactatactgctttcctgattgacaaggagtcagaaaacatcaagtccagtgatgaaatagagaatgccttccaagccctggcagagggcaagtcatatattaccaaagaagacatgaagcaggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcacgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctgggg

SEQ ID NO: 732962 - DNA, 374 bp, Homo sapiens
catgtttactacttgccgggtagaactggaggatagactttagaacaagaaatcatataattgaaaactacctttgctacttttggaattttaaaactgaaataattttagaaataattcgacctccctcatttgtaaatgatgaaagacttaaacaatttcacacaatgagaaaatgccagaaccagggctcgtaccgctaactcacatgttcaaccatcaaagtacacagtccctattggttttagttctgcccttttagattggtggccctgcagatatttaaagacaggcattatttttatcctcaatcttctcttctgctgagaggctttatcaggaaagatggtagtgtcttttttttctctctgcag

SEQ ID NO: 732963 - DNA, 1198 bp, Homo sapiens
acactttgatgagaatttgacagggcgcctgactcacaaagagttccggtcctgcctgagaggactcaattactacttgcccatggtggaggaggatgaacatgagcccaagtttgagaagttcctggatgctgtggatccagggaggaagggctatgtctcactggaggactatactgctttcctgattgacaaggagtcagaaaacatcaagtccagtgatgaaatagagaatgccttccaagccctggcagagggcaagtcatatattaccaaagaagacatgaagcaggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcacgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctggggaacatgaatattttagtttgtacaatgaaacaacacacagatcagcataacacctgttttcttcttgttttttttccatacttcaaaattattgtagatgttattactctcagaaagacaaaattccagcatagcagggctttctcttgtcctccaagctcccgtattttctcttaagttttaatgtaataaaaataatacttcaatatcctgttaaagtaa

SEQ ID NO: 732964 - DNA, 1201 bp, Homo sapiens; identical to SEQ ID NO: 76156

SEQ ID NO: 732965 - DNA, 979 bp, Homo sapiens
caaatgttgttaggcatataattccttctatttaataaaacaactttagggaatgagatttacagaataatcaaagtgagtaagctctctttttcaagaaagggctgagattaaaagttaagttactcattagaaattataaatttatgagataaaaattgtgtgtaatagaaatagggcttgcgtcttccagagactctccatctcctgcatttatggcgtaatatgggaagccccaaggaaccagctattttgaatccctataactgtatttttctctttttatacttttcaggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcacgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctgggg

SEQ ID NO: 732966 - DNA, 1136 bp, Homo sapiens
atgttccaggggaactgtgatcaagttgagagccggatggtggcacgtgagaattccctgaggtcagatgacaaaagttccttagacagtctggaggctttgatgaagaaacgggacgatttggacaaagcaatcactgcccaggaagggaagatcactgacctagaacattttgctgagagcctcattgctgatgaacactatgccaaagaagagattgctacgcggctccaacgtgtactagacaggtggaaggctctcaaagcacaactgattgatgagcggacaaagcttggagactatgccaacctaaaacaattctaccgagaccttgaggagctggaagaatggatcagtgagatgctgcccacagcctgtgatgaatcctacaaagacgccactaacattcagaggaaatacctgaaacaccagacctttgcacatgaagtcgatggccgatctgagcaggtgcatggcgtcatcaacctggggaactccctgattgagcgtagttgtgatggcaatgaagaggccatgaaggagcaactggaacagctgaaggaacattgggatcatctgcttgagagaacaaatgacaaagggaagaagctcaatgaggccagtcgtcaacagaggttcaacacaagcatccgggactttgagttctggctctcagaggcagagacattgctggccatgaaagatcaggccagggacttggcttcagcaggaaacctactcaagaagcatcagctattggagagagagatgttggctcgagaggtaagtagtgttggcatccctctcctctgggcagaatagaaatatttctggctcttctccctcccatgttaggagaccatttgaaaacatagccttgcaaaattgttcttagtgttctcaaccagcagtcattttaattaggtaaaattaacgggctgtgaagacattaaaactgtcactgataatcaattatccctaaactatagactttaagattccagaaagtggacctgggaaactatcttttttatcttttactgatgcatacatataagccaattgtctttaagctatatatttgatctggtatttgaaagaaagtggaagtttactttatagaattacaaacaaaa

SEQ ID NO: 732967 - DNA, 1348 bp, Homo sapiens; identical to SEQ ID NO: 76155

SEQ ID NO: 732968 - DNA, 1126 bp, Homo sapiens
gaaagcctaagtgtttcaggcaaaggcaagtgtgtgtgcaaaggaacttgagaaaacagattttcctaatacctaaagcataaggtaagaagatagtaacagaaagtgaaagggaaaacaattaagcagaaaccagattacaaagggtcacatacatgatggtatcgttttgcacaaactcatccaattgtctaaactcatcaaactgtacacattaaaggtgcaattctttatcaatcatacctcgacaaagctgttacaaaaagaaaatgatgtggtcttccagacactatctggagccacccacccacacgctaacttattggagtctttagggatccacttggtaatcaaacagcacagtgaatagaggaactctttggcataagaggatcataggttcaagtcccagctctaccactttctggcagtgtaaccactggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcacgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctgggg

SEQ ID NO: 732969 - DNA, 1382 bp, Homo sapiens
aggacttaagttggaagaatccctagaatacttgcaattcatgcagaatgctgaggaagaggaagcttggatcaatgaaaagaatgctttggctgtccgaggagattgtggagatacattagctgctactcagagcttgctaatgaagcatgaagctttggaaaatgactttgctgtccatgagacccgagtacaaaatgtgtgtgcacaaggagaagacatcctaaataaggtgttgcaggaggaaagtcagaacaaagagatttcttccaagatagaggctctgaatgaaaagaccccttctctggctaaggcaatagctgcttggaagttgcaattggaagacgattatgcctttcaggaattcaactggaaggctgatgtggtagaggcttggatagctgataaggaaacaagcctaaagaccaatggcaatggtgcagaccttggtgacttcctcactcttctggcaaaacaggacactctggatgccagtctgcagagtttccagcaagagagacttcccgagatcactgacctgaaggacaaactgatttctgctcaacacaaccagtctaaagccattgaagagcgttatgccgctctgctgaagcgctgggaacagttgctggaagcctcggcagtccacagacagaaattgctggagaaacagctgcctctacagaaggtttaaaaaaattatgaggcatgatcagttctctgttacctgtatattagccatgaaattcggaaacagatattgggaaactcagtttgggataatacaaaaaccttttattgcattgaaagatgttgggaagacattcttactgagcaaaaagtagattgaaaagaagctttaaaaattttttttagattgattgattagttgcataactaacttgagatggaagccaggcaaacagtggaagaggtggatggaacaagaggatgggaggtctttgtgtatgatagaattaaaactgtcaggcaaaagtcaaggttgtccctgtacttttcctaacccaaataaaaggagcactggacaagttgtcataaaacatgttctcaccttatatcaagctttcctaggttgaagaccttgtaaaagtcatttaatatctctaaaccttgatatccccatttagaaaattgagtagcatcaccattctattctgcctttctgttatcactattaaaaaagataatgaatctaaaagtgtaataattccatattattacattattacattcatataaatatgtatggttgtaatatgtgtgtattaataatacataattatatgtacattatctgtacctaaatatatgtacattaataatacataataaatatgtatgattaatatggaataatataa

SEQ ID NO: 732970 - DNA, 385 bp, Homo sapiens; identical to SEQ ID NO: 76163

SEQ ID NO: 732971 - DNA, 491 bp, Homo sapiens
ggatgtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 732972 - DNA, 739 bp, Homo sapiens
ggatgtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 732973 - DNA, 512 bp, Homo sapiens
  misc_feature (3)..(3): n is a, c, g, or t
gcngccgcctactactactaaattcgcggccgtcgacaaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 732974 - DNA, 747 bp, Homo sapiens
  misc_feature (602)..(602): n is a, c, g, or t
  misc_feature (609)..(609): n is a, c, g, or t
  misc_feature (627)..(627): n is a, c, g, or t
  misc_feature (643)..(643): n is a, c, g, or t
  misc_feature (657)..(657): n is a, c, g, or t
ggatgtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaacaacacaaaacaacaaaaaaaaaaaaatttgtggggcggccctgggcccccggaaaaagtttttaagacccttcgttgggggcgcgggggccccacttgggtangggacangggccaaagggggcccanagagaacccgggcaanagaaggggggggtncccccataaaaagccgcgggaaccgcgtcgaccatccagggtgcgggacacggcttataccggccacagcgaaatcgccgcggagggggc

SEQ ID NO: 732975 - DNA, 385 bp, Homo sapiens
attcgcggccgcgtcgacggagtcctgcttatcacaatgaatgttctcctgggcagcgttgtgatctttgccaccttcgtgactttatgcaatgcatcatgctatttcatacctaatgagggagttccaggagattcaaccaggatgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 732976 - DNA, 504 bp, Homo sapiens
gcctactactactactactaaattcgcggccggtcgactgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 732977 - DNA, 625 bp, Homo sapiens
ggatgtacctgtctataaggagtcctgcttatcacaatggggctcccaaacttggctgtgcagtggaaactccgggggaattttgaagaacactgacacccatcttccaccccgacactctgatttaattgggctgcagtgagaacagagcatcaatttaaaaagctgcccagaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 732978 - DNA, 777 bp, Homo sapiens
  misc_feature (3)..(3): n is a, c, g, or t
  misc_feature (542)..(542): n is a, c, g, or t
  misc_feature (544)..(544): n is a, c, g, or t
  misc_feature (548)..(548): n is a, c, g, or t
  misc_feature (777)..(777): n is a, c, g, or t
gcngccgcctactactactaaattcgcggccgtcgacaaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaacaaacaacaccacccccaccaaaaaacntntttngggccgactcgggcgccgaggagaaagggcttcaaacacccactccttggggccccgggggcccccagtgagtagctcaaacgtgccaaaagcggcccccaaggagaaccggggccagaacaagcgtggggcttctccccaaaaaaaagcgcggggacaaccgcggctctgaacaccagggggtcgaggcaaggcctcccaggggcagggacgtaacccgcgggtgggn

SEQ ID NO: 732979 - DNA, 640 bp, Homo sapiens
ggtgcttgttggctttaacatccacaatgaacacaagtgtgttgttgtcttctatcttcttcgtggtgactcagtggtcagcggaaacttgatgatagcgtagtggtcaagcttgtatctcctgggagcgactcttccaaagatatttgggctgcctcgggagttgcagcgtcttgggccgccggaagaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 732980 - DNA, 743 bp, Homo sapiens
  misc_feature (517)..(518): n is a, c, g, or t
gcctactactactactactaaattcgcggccggtcgactgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaacaanncaaaacaaacaaacacccaaacgaaaccacagccaatcctagccctccacaccaccacaccaccaccacaccgatacgcgctgcgcgctagcccaaaaccaagaacacacatgaggcgccgccgcgccccagcaaaaattatcaacacatctcgtggcggcgcccagacatctaacacgcttaccggcccaaagagcggacagaggggggctccacaaaaacggg

SEQ ID NO: 732981 - DNA, 664 bp, Homo sapiens
ggtgcttgttggctttaacatccacaatgaacacaagtgtgttgttgtcttctatcttcttcgtggtgactcagtggtcagcggaaacttgatgatagcgtagtggtcaagcttgtatctcctgggagcgactcttccaaagatatttgggctgcctcgggagttgcagcgtcttgggccgccggaaggtgggtgacgtacggatcttctttttttgtgtggctgtggacacctttcaacactgtcttcttggcctttaaatccttcgctttggtttcggctttaggaggggcaggagcttccttcttcactttcggcgccatcttgtgaaaagggaaagtttcctttctaataccattttcacttctcccgaattttgtggatcgtttcttggtatctaccccagatttcaagagtgttggctggatcttacggattgtgaagtcttcatttccctgtggtgagatctgaggcatgattttaaacagtgtgagggaaggagatctccaggcactttaatagaatggagaagcaggatgggatttgagaggaaatctgattttgaaaaaaggagaactagagttgagttcgtaattaactagcaccttaaaggtcattcagcatgcccatctgcacagtgggtgtaatcaccctacagaacaaa

SEQ ID NO: 732982 - DNA, 501 bp, Homo sapiens; identical to SEQ ID NO: 323914

SEQ ID NO: 732983 - DNA, 723 bp, Homo sapiens
ggatgtacctgtctataaggagtcctgcttatcacaatgaatgttctcctgggcagcgttgtgatctttgccaccttcgtgactttatgcaatgcatcatgctatttcatacctaatgagggagttccaggagattcaaccaggagtaagtcttggcttttcaatgtttattatgttattgcagcctggtagatggacctgtctgcagatgaaagcctttgtgtttctgtttgtttgtttctttgttttttgagatagtcatgctctgtctcccaggctggagtgcagtggcaccatttcagctcactgcaaactcctcctcccgggttccagtgattctacctcctcagcctcccaagtagctgggactacaggtgtgtgccatcatgcctggctaatttttgtatttttggtaaagatggggctttgccacgttggccaggctggtctcgaactcctgacctcaggtcatctgcccgccacagcctcccaaagtgttgggattacaggtgtgagccactgtgcctggcctcacttgggcagccttctaagaacacagtagcctgggccctgtacccagagatactgatttcattgttctagggtaaggctgagacatgggtggctttcaagtacccaagatgtttcacatgtgcacccagggttgaaaaccaccgatgcaaagcaaagggaagtgtagaagtgagattctcatccagagat

SEQ ID NO: 732984 - DNA, 503 bp, Homo sapiens; identical to SEQ ID NO: 323908

SEQ ID NO: 732985 - DNA, 725 bp, Homo sapiens
ggatgtacctgtctataaggagtcctgcttatcacaatggggctcccaaacttggctgtgcagtggaaactccgggggaattttgaagaacactgacacccatcttccaccccgacactctgatttaattgggctgcagtgagaacagagcatcaatttaaaaagctgcccaggatcacatcttggagatgaaaaggtgaaatcaaatgttgtaaacggttttaagaatgtggatatatagtagcaaattgttctccttaacgattgttcaaaaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 732986 - DNA, 548 bp, Homo sapiens
  misc_feature (403)..(403): n is a, c, g, or t
  misc_feature (410)..(410): n is a, c, g, or t
  misc_feature (428)..(428): n is a, c, g, or t
  misc_feature (444)..(444): n is a, c, g, or t
  misc_feature (458)..(458): n is a, c, g, or t
ggatgtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaaaaaaaaacaacacaaaacaacaaaaaaaaaaaaatttgtggggcggccctgggcccccggaaaaagtttttaagacccttcgttgggggcgcgggggccccacttgggtangggacangggccaaagggggcccanagagaacccgggcaanagaaggggggggtncccccataaaaagccgcgggaaccgcgtcgaccatccagggtgcgggacacggcttataccggccacagcgaaatcgccgcggagggggc

SEQ ID NO: 732987 - DNA, 359 bp, Homo sapiens
  misc_feature (3)..(3): n is a, c, g, or t
gcngccgcctactactactaaattcgcggccgaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 732988 - DNA, 385 bp, Homo sapiens
ggatgtacctgtctataaggagtcctgcttatcacaatgaatgttctcctgggcagcgttgtgatctttgccaccttcgtgactttatgcaatgcatcatgctatttcatacctaatgagggagttccaggagattcaaccaggatgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 732989 - DNA, 760 bp, Homo sapiens
  misc_feature (3)..(3): n is a, c, g, or t
gcngccgcctactactactaaattcgcggccgtcgacaaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 732990 - DNA, 768 bp, Homo sapiens
  misc_feature (3)..(3): n is a, c, g, or t
  misc_feature (623)..(623): n is a, c, g, or t
  misc_feature (630)..(630): n is a, c, g, or t
  misc_feature (648)..(648): n is a, c, g, or t
  misc_feature (664)..(664): n is a, c, g, or t
  misc_feature (678)..(678): n is a, c, g, or t
gcngccgcctactactactaaattcgcggccgtcgacaaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaacaacacaaaacaacaaaaaaaaaaaaatttgtggggcggccctgggcccccggaaaaagtttttaagacccttcgttgggggcgcgggggccccacttgggtangggacangggccaaagggggcccanagagaacccgggcaanagaaggggggggtncccccataaaaagccgcgggaaccgcgtcgaccatccagggtgcgggacacggcttataccggccacagcgaaatcgccgcggagggggc

SEQ ID NO: 732991 - DNA, 752 bp, Homo sapiens
gcctactactactactactaaattcgcggccggtcgactgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 732992 - DNA, 760 bp, Homo sapiens
  misc_feature (615)..(615): n is a, c, g, or t
  misc_feature (622)..(622): n is a, c, g, or t
  misc_feature (640)..(640): n is a, c, g, or t
  misc_feature (656)..(656): n is a, c, g, or t
  misc_feature (670)..(670): n is a, c, g, or t
gcctactactactactactaaattcgcggccggtcgactgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaacaacacaaaacaacaaaaaaaaaaaaatttgtggggcggccctgggcccccggaaaaagtttttaagacccttcgttgggggcgcgggggccccacttgggtangggacangggccaaagggggcccanagagaacccgggcaanagaaggggggggtncccccataaaaagccgcgggaaccgcgtcgaccatccagggtgcgggacacggcttataccggccacagcgaaatcgccgcggagggggc

SEQ ID NO: 732993 - DNA, 873 bp, Homo sapiens
ggatgtacctgtctataaggagtcctgcttatcacaatggggctcccaaacttggctgtgcagtggaaactccgggggaattttgaagaacactgacacccatcttccaccccgacactctgatttaattgggctgcagtgagaacagagcatcaatttaaaaagctgcccagaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 732994 - DNA, 881 bp, Homo sapiens
  misc_feature (736)..(736): n is a, c, g, or t
  misc_feature (743)..(743): n is a, c, g, or t
  misc_feature (761)..(761): n is a, c, g, or t
  misc_feature (777)..(777): n is a, c, g, or t
  misc_feature (791)..(791): n is a, c, g, or t
ggatgtacctgtctataaggagtcctgcttatcacaatggggctcccaaacttggctgtgcagtggaaactccgggggaattttgaagaacactgacacccatcttccaccccgacactctgatttaattgggctgcagtgagaacagagcatcaatttaaaaagctgcccagaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaacaacacaaaacaacaaaaaaaaaaaaatttgtggggcggccctgggcccccggaaaaagtttttaagacccttcgttgggggcgcgggggccccacttgggtangggacangggccaaagggggcccanagagaacccgggcaanagaaggggggggtncccccataaaaagccgcgggaaccgcgtcgaccatccagggtgcgggacacggcttataccggccacagcgaaatcgccgcggagggggc

SEQ ID NO: 732995 - DNA, 519 bp, Homo sapiens
ggatgtacctgtctataaggagtcctgcttatcacaatggggctcccaaacttggctgtgcagtggaaactccgggggaattttgaagaacactgacacccatcttccaccccgacactctgatttaattgggctgcagtgagaacagagcatcaatttaaaaagctgcccagaatgttctcctgggcagcgttgtgatctttgccaccttcgtgactttatgcaatgcatcatgctatttcatacctaatgagggagttccaggagattcaaccaggatgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 732996 - DNA, 598 bp, Homo sapiens
  misc_feature (3)..(3): n is a, c, g, or t
gcngccgcctactactactaaattcgcggccgtcgacaaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaacacttgaatatgtgtgtccttttaatttataatttatgtatgcattgatttaatacacattataaagaatacaaacatttaaaaa

SEQ ID NO: 732997 - DNA, 888 bp, Homo sapiens
ggtgcttgttggctttaacatccacaatgaacacaagtgtgttgttgtcttctatcttcttcgtggtgactcagtggtcagcggaaacttgatgatagcgtagtggtcaagcttgtatctcctgggagcgactcttccaaagatatttgggctgcctcgggagttgcagcgtcttgggccgccggaagaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 732998 - DNA, 896 bp, Homo sapiens
  misc_feature (751)..(751): n is a, c, g, or t
  misc_feature (758)..(758): n is a, c, g, or t
  misc_feature (776)..(776): n is a, c, g, or t
  misc_feature (792)..(792): n is a, c, g, or t
  misc_feature (806)..(806): n is a, c, g, or t
ggtgcttgttggctttaacatccacaatgaacacaagtgtgttgttgtcttctatcttcttcgtggtgactcagtggtcagcggaaacttgatgatagcgtagtggtcaagcttgtatctcctgggagcgactcttccaaagatatttgggctgcctcgggagttgcagcgtcttgggccgccggaagaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaacaacacaaaacaacaaaaaaaaaaaaatttgtggggcggccctgggcccccggaaaaagtttttaagacccttcgttgggggcgcgggggccccacttgggtangggacangggccaaagggggcccanagagaacccgggcaanagaaggggggggtncccccataaaaagccgcgggaaccgcgtcgaccatccagggtgcgggacacggcttataccggccacagcgaaatcgccgcggagggggc

SEQ ID NO: 732999 - DNA, 751 bp, Homo sapiens
gcctactactactccccggggggcggccgcgtcgacctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 733000 - DNA, 759 bp, Homo sapiens
  misc_feature (614)..(614): n is a, c, g, or t
  misc_feature (621)..(621): n is a, c, g, or t
  misc_feature (639)..(639): n is a, c, g, or t
  misc_feature (655)..(655): n is a, c, g, or t
  misc_feature (669)..(669): n is a, c, g, or t
gcctactactactccccggggggcggccgcgtcgacctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaacaacacaaaacaacaaaaaaaaaaaaatttgtggggcggccctgggcccccggaaaaagtttttaagacccttcgttgggggcgcgggggccccacttgggtangggacangggccaaagggggcccanagagaacccgggcaanagaaggggggggtncccccataaaaagccgcgggaaccgcgtcgaccatccagggtgcgggacacggcttataccggccacagcgaaatcgccgcggagggggc

SEQ ID NO: 733001 - DNA, 678 bp, Homo sapiens
attcgcggccgcgtcgacggagtcctgcttatcacaatgaatgttctcctgggcagcgttgtgatctttgccaccttcgtgactttatgcaatgcatcatgctatttcatacctaatgagggagttccaggagattcaaccaggatgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaaaaaaaaaaaaaaaaaaggcgcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 733002 - DNA, 933 bp, Homo sapiens
ggtgcttgttggctttaacatccacaatgaacacaagtgtgttgttgtcttctatcttcttcgtggtgactcagtggtcagcggaaacttgatgatagcgtagtggtcaagcttgtatctcctgggagcgactcttccaaagatatttgggctgcctcgggagttgcagcgtcttgggccgccggaagaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaaaaaaaaaaaaaaaaaaggcgcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 733003 - DNA, 918 bp, Homo sapiens
ggatgtacctgtctataaggagtcctgcttatcacaatggggctcccaaacttggctgtgcagtggaaactccgggggaattttgaagaacactgacacccatcttccaccccgacactctgatttaattgggctgcagtgagaacagagcatcaatttaaaaagctgcccagaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaaaaaaaaaaaaaaaaaaggcgcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 733004 - DNA, 812 bp, Homo sapiens
ggatgtacctgtctataaggagtcctgcttatcacaatggggctcccaaacttggctgtgcagtggaaactccgggggaattttgaagaacactgacacccatcttccaccccgacactctgatttaattgggctgcagtgagaacagagcatcaatttaaaaagctgcccagaatgttctcctgggcagcgttgtgatctttgccaccttcgtgactttatgcaatgcatcatgctatttcatacctaatgagggagttccaggagattcaaccaggatgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaaaaaaaaaaaaaaaaaaggcgcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 733005 - DNA, 805 bp, Homo sapiens
  misc_feature (3)..(3): n is a, c, g, or t
gcngccgcctactactactaaattcgcggccgtcgacaaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaaaaaaaaaaaaaaaaaaggcgcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 733006 - DNA, 797 bp, Homo sapiens
gcctactactactactactaaattcgcggccggtcgactgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaaaaaaaaaaaaaaaaaaggcgcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 733007 - DNA, 784 bp, Homo sapiens
ggatgtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaaaaaaaaaaaaaaaaaaggcgcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 733008 - DNA, 678 bp, Homo sapiens
ggatgtacctgtctataaggagtcctgcttatcacaatgaatgttctcctgggcagcgttgtgatctttgccaccttcgtgactttatgcaatgcatcatgctatttcatacctaatgagggagttccaggagattcaaccaggatgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaaaaaaaaaaaaaaaaaaggcgcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 733009 - DNA, 796 bp, Homo sapiens
gcctactactactccccggggggcggccgcgtcgacctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaaaaaaaaaaaaaaaaaaggcgcaaaaaaaaaaaaaaaaaaaaaaaacatttgggggggcggccgggcccagaaaaaggttttaaacaccattcgtgtgggggcggcgggcccagtgggttacggacaccttgggccaaagggggcccaaagagaaaccggggccagacatgggggtgggtctcccccataaaaaccgcggcggcaccgggggtctggaccaatccagagggtcggggccacggtcaccacgggtcccgaaccaaaataggagg

SEQ ID NO: 733010 - DNA, 1491 bp, Homo sapiens
tttcgaccccgcgtccggacggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtcggcgttcggttactcaccttccaacgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcaaaaa

SEQ ID NO: 733011 - DNA, 535 bp, Homo sapiens
atgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagggtaattactcccggattgcataaaagcctgtacacatggttttccagattatctttccaaaaaaaaaaaaaaaag

SEQ ID NO: 733012 - DNA, 570 bp, Homo sapiens
atgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgcttaaaaaaaaaaaatttggggggggcggggccggaagaaggtcttcctaaaaaccccatctgggttgtgggcggcgcggggcgccacgatgggtatggtagaccgcgtgcgccaacagcgcgtgttcccaaggagaaacccgggcgccacagaactgcggcggctgtggtcttccccaaaaaaaaaacgcgccggggggggcaccgggcgggctcttctgacaaccccagaaggggggtccagaggggcaccaccggggctcactcccgcgaggccctaggacgccaaataaattgcccaccaagg

SEQ ID NO: 733013 - DNA, 971 bp, Homo sapiens
tatccttctgggggattgcaggaaaagaagtttgctacgaaagactcggctgcttcagtgatgactccccatggtcaggaattacggaaagaccctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtcggcgttcggttactcaccttccaacgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacagga

SEQ ID NO: 733014 - DNA, 1083 bp, Homo sapiens
atgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaacatcaggatcgtgggagcagaagtggcatatttcgtgaattcttcagtcggcgttcggttactcaccttccaacgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacagga

SEQ ID NO: 733015 - DNA, 854 bp, Homo sapiens
atgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgcttcacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcaaaaaacacacacaacaaaacaacttggggggggcccggccggaaaatttaaaccccgtgggcgggcccgatgttgaccgggctcacgcggccagaccgggcggacacgggggttcccaaaaaccgggcggcgtcgcaaccaggggccgggcaggtcaacggcagcgacccgcccgcgcaccccccctgcccccccgcgccccaccgctaccctcgggccccacccgcctatttcttacgccca

SEQ ID NO: 733016 - DNA, 567 bp, Homo sapiens
atgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgcttgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcaaaaa

SEQ ID NO: 733017 - DNA, 736 bp, Homo sapiens
tcaccctggggaattccaagacattgtccttgaaggaggctccaagctcaggacctcaggatgggagatgaggagaagcggaacagggccatcacggcccgcaggcagcacctgaagagcgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagagcctgccagggagggctggcctcaccaccaccgtcaataaaggatttgaatcccca

SEQ ID NO: 733018 - DNA, 484 bp, Homo sapiens
  misc_feature (441)..(441): n is a, c, g, or t
aagcggaacagggccatcacggcccgcaggcagcacctgaagagcgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggancggacctgcgaacgtgggtaggaggtgaagatcctgtagagtg

SEQ ID NO: 733019 - DNA, 692 bp, Homo sapiens; identical to SEQ ID NO: 76836
  misc_feature (43)..(43): n is a, c, g, or t
  misc_feature (45)..(45): n is a, c, g, or t

SEQ ID NO: 733020 - DNA, 515 bp, Homo sapiens
  misc_feature (43)..(43): n is a, c, g, or t
  misc_feature (45)..(45): n is a, c, g, or t
  misc_feature (472)..(472): n is a, c, g, or t
tgctgaggtactctaaggatctccctcctacccacgggaacangncatcatggcccgcaggcagcacctgaagagcgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggancggacctgcgaacgtgggtaggaggtgaagatcctgtagagtg

SEQ ID NO: 733021 - DNA, 393 bp, Homo sapiens; identical to SEQ ID NO: 80745

SEQ ID NO: 733022 - DNA, 1074 bp, Homo sapiens
ggagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaacatgaaccaggaggacgttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 733023 - DNA, 508 bp, Homo sapiens
ggagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaacatgaaccagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 733024 - DNA, 334 bp, Homo sapiens; identical to SEQ ID NO: 80747

SEQ ID NO: 733025 - DNA, 752 bp, Homo sapiens
ggagtgcctgcagccggtgctgtccacagggagctccagcccttctcacactcgacccgcagaaaccacccaccttcaccatgtctgacgaggaagttgaacaggtggaggaggaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 733026 - DNA, 1074 bp, Homo sapiens
ggagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaacatgaaccaggaggacgttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcatgaatgtccgggccagagtgcagatgctggccaagttcagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 733027 - DNA, 1093 bp, Homo sapiens
ggagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaacatgaaccaggaggacgttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccccccccttcacagtctgtac

SEQ ID NO: 733028 - DNA, 927 bp, Homo sapiens
ggagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaacatgaaccaggaggacgttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 733029 - DNA, 753 bp, Homo sapiens; identical to SEQ ID NO: 80755

SEQ ID NO: 733030 - DNA, 606 bp, Homo sapiens
ctccctcggaggagccggggacagggctgagcagacccccttctctggctgcaggagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 733031 - DNA, 772 bp, Homo sapiens
ctccctcggaggagccggggacagggctgagcagacccccttctctggctgcaggagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccccccccttcacagtctgtac

SEQ ID NO: 733032 - DNA, 753 bp, Homo sapiens
ctccctcggaggagccggggacagggctgagcagacccccttctctggctgcaggagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcatgaatgtccgggccagagtgcagatgctggccaagttcagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 733033 - DNA, 1025 bp, Homo sapiens
ggagtgcctgcagccggtgctgtccacagggagctccagcccttctcacactcgacccgcagaaaccacccaccttcaccatgtctgacgaggaagttgaacaggtggaggaggaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 733034 - DNA, 1044 bp, Homo sapiens
ggagtgcctgcagccggtgctgtccacagggagctccagcccttctcacactcgacccgcagaaaccacccaccttcaccatgtctgacgaggaagttgaacaggtggaggaggaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccccccccttcacagtctgtac

SEQ ID NO: 733035 - DNA, 878 bp, Homo sapiens
ggagtgcctgcagccggtgctgtccacagggagctccagcccttctcacactcgacccgcagaaaccacccaccttcaccatgtctgacgaggaagttgaacaggtggaggaggaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 733036 - DNA, 1025 bp, Homo sapiens
ggagtgcctgcagccggtgctgtccacagggagctccagcccttctcacactcgacccgcagaaaccacccaccttcaccatgtctgacgaggaagttgaacaggtggaggaggaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcatgaatgtccgggccagagtgcagatgctggccaagttcagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 733037 - DNA, 1075 bp, Homo sapiens
cagtacgaagaagaagaggaagcccaggaggaagctgcagaagtccatgaggaacatgaaccaggaggacgttcaagaagaggagaaaccgagacccaaccgcactggcttttctcttgcatgtgtgcttgtgccttttgccacctggaagacaccgcagaggaggacgcggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccccccccttcacagtctgtac

SEQ ID NO: 733038 - DNA, 1056 bp, Homo sapiens
cagtacgaagaagaagaggaagcccaggaggaagctgcagaagtccatgaggaacatgaaccaggaggacgttcaagaagaggagaaaccgagacccaaccgcactggcttttctcttgcatgtgtgcttgtgccttttgccacctggaagacaccgcagaggaggacgcggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 733039 - DNA, 909 bp, Homo sapiens
cagtacgaagaagaagaggaagcccaggaggaagctgcagaagtccatgaggaacatgaaccaggaggacgttcaagaagaggagaaaccgagacccaaccgcactggcttttctcttgcatgtgtgcttgtgccttttgccacctggaagacaccgcagaggaggacgcggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 733040 - DNA, 1056 bp, Homo sapiens
cagtacgaagaagaagaggaagcccaggaggaagctgcagaagtccatgaggaacatgaaccaggaggacgttcaagaagaggagaaaccgagacccaaccgcactggcttttctcttgcatgtgtgcttgtgccttttgccacctggaagacaccgcagaggaggacgcggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcatgaatgtccgggccagagtgcagatgctggccaagttcagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 733041 - DNA, 2399 bp, Homo sapiens
actaactctacctttctggcttcagggggaggagagttagatcatgcatttgtccgatccatctctgttcacaggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgtcaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaaaaaaaaataaattgacagcagagaggaacacacact

SEQ ID NO: 733042 - DNA, 988 bp, Homo sapiens
gacttggaggaagaagagtgctcattgcaagctgttggctggaacctcacctggcctagcagtgtcctggagcaatgtggccccgtcctcggcctgtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaaaaaaaaataaattgacagcagagaggaacacacact

SEQ ID NO: 733043 - DNA, 701 bp, Homo sapiens
atctcagcgcaataatgaacacgcccggtcggacgaactgagctgattctagagatcgaggatagtgccaagatgggagatgtctcgtacggctacagttactggtatctcagtcacacagtgatgtccggagattcggagcggcgatatctggatctaagtctccgctccgatgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaaaaaaaaataaattgacagcagagaggaacacacact

SEQ ID NO: 733044 - DNA, 454 bp, Homo sapiens
tctgattggtcagcctagacgaggcagcttatgttaatttgcacaaaagtacagcagtactagcagttgccctgtcactgttttcttttcagggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaaaaaaaaataaattgacagcagagaggaacacacact

SEQ ID NO: 733045 - DNA, 1919 bp, Homo sapiens
actaactctacctttctggcttcagggggaggagagttagatcatgcatttgtccgatccatctctgttcacaggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgtcaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacggtacgtcctggccagtgggggacagaaccagagcactgcctggttcaagtttcagctctatcacttcctagttatagaagctttggggagttatttagcctggctgtgcctcagtttcatcaactgtaaagtggagaaataatagtacctactccacaggtgtattgagaggattgaatgagttaatgtgttgaagtgattaggacagtgactgcacacagtaagtgctcaataaacatcagcttcaaataaagaaagcaattcatggtgatagttctccattttacagatgggaaaagtagggccatagtagggattgtctcagccagtaggcatcagcattgggttcagaaactagtctatttgtctccagtggtcctggaaggcaaggtctgtatccttaatgtacagagaatcaggacctcacctacagaggcctcctcaaatgaaacccagaggtaaatgtttgtgtgagcagagcattatctcctgccacctccctcattaccagaggaagaaagaaagagaaagagaggaagaaagaaagagaaggaaggaaag

SEQ ID NO: 733046 - DNA, 2290 bp, Homo sapiens
gagactaactctacctttctggcttcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgtcaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaaaaaaaaataaattgacagcagagaggaacacacact

SEQ ID NO: 733047 - DNA, 1810 bp, Homo sapiens; identical to SEQ ID NO: 494324

SEQ ID NO: 733048 - DNA, 2154 bp, Homo sapiens
actaactctacctttctggcttcagggggaggagagttagatcatgcatttgtccgatccatctctgttcacaggacaccagacatcagagacagagagaaaaattcaaagggccaacccgtctttcctttgggcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgtcaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcaagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaaaaaaaaataaattgacagcagagaggaacacacact

SEQ ID NO: 733049 - DNA, 2045 bp, Homo sapiens
gagactaactctacctttctggcttcaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgccattcctggagctcacaactgctccgccaacagcagctgcgtaaacacgccaggctccttctcctgcgtctgccccgaaggcttccgcctgtcgcccggtctcggctgcacagacgtggatgagtgcgctgagcctgggcttagccactgccacgccctggccacatgtgtcaatgtggtgggcagctacttgtgcgtatgccccgcgggctaccggggggatggatggcactgtgagtgctccccgggctcctgcgggccggggttggactgcgtgcccgagggcgacgcgctcgtgtgcgcggatccgtgtcaggcgcaccgcaccctggacgagtactggcgcagcaccgagtacggggagggctacgcctgcgacacggacctgcgcggctggtaccgcttcgtgggccagggcggtgcgcgcatggccgagacctgcgtgccagtcctgcgctgcaacacggccgcccccatgtggctcaatggcacgcatccgtccagcgacgagggcatcgtgagccgcaaggcctgcgcgcactggagcggccactgctgcctgtgggatgcgtccgtccaggtgaaggcctgtgccggcggctactacgtctacaacctgacagcgccccccgagtgtcacctggcgtactgcacagaccccagctccgtggaggggacgtgtgaggagtgcagtatagacgaggactgcaaatcgaataatggcagatggcactgccagtgcaaacaggacttcaacatcactgatatctccctcctggagcacaggctggaatgtggggccaatgacatgaaggtgtcgctgggcaagtgccagctgaagagtctgggcttcgacaaggtcttcatgtacctgagtgacagccggtgctcgggcttcaatgacagagacaaccgggactgggtgtctgtagtgaccccagcccgggatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcaagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaaaaaaaaataaattgacagcagagaggaacacacact

SEQ ID NO: 733050 - DNA, 1284 bp, Homo sapiens
caggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcccctgtgggacagtgttgacgaggaatgaaacccatgccacttacagcaacaccctctacctggcagatgagatcatcatccgtgacctcaacatcaaaatcaactttgcatgctcctaccccctggacatgaaagtcagcctgaagaccgccctacagccaatggtcagtgctctaaacatcagagtgggcgggaccggcatgttcaccgtgcggatggcgctcttccagaccccttcctacacgcagccctaccaaggctcctccgtgacactgtccactgaggcttttctctacgtgggcaccatgttggatgggggcgacctgtcccgatttgcactgctcatgaccaactgctatgccacacccagtagcaatgccacggaccccctgaagtacttcatcatccaggacagatgcccacacactagagactcaactatccaagtggtggagaatggggagtcctcccagggccgattttccgtccagatgttccggtttgctggaaactatgacctagtctacctgcactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctgaggcccccatctccttaaagagtgtggcaaaataatgatttttaaatctcaaaaaaaaataaattgacagcagagaggaacacacact

SEQ ID NO: 733051 - DNA, 155 bp, Homo sapiens; identical to SEQ ID NO: 319219

SEQ ID NO: 733052 - DNA, 672 bp, Homo sapiens
ggtttgtcttggtccattttatgctgctataacagaacaccacagactgagaaatttataaggaatagaagtttatttgcctcatgtttctggaggctgggaattccaagatcaaggggctgcatagattgaggtcctttttgctgactcataacgtggaaagagagtgcactgcatagaagaaaggaggccaaactcattcttttatcatgagcctactcctgaaataactcactctcaagataatggcattaatccattcatgaaggcagaatactcatgatgtaatcacctcttaaaaggtcctatttcctaacactgttgcattagggattaagctgtcaacacatgaatattgggggacacattcaaaccatagcaagagttctttgtctttgtgactcggtgtggttcagcaaattgcgattggtctgctatagcggactttcccctcacctcccaaatgtttattatgaaaaatttcattttaaagaaaggtggaaggaattgttgaaagaatatgtcatctagtttctactgttgttaacattgtgtcatatttgccttttcatccatccaaccacccatccatctagctaccttataattactattattacttattattactattatttttaaagacacctctattaaagcaaccatcttatt

SEQ ID NO: 733053 - DNA, 470 bp, Homo sapiens
gaggtaaaatttacatacagtgaaatccaaatcttaagtgtaccactagataaattttgataaatgcattatgcctggtcttcacacacccttttcaatatatagaaaatttccagataatttattttgttgtttttttcacacactaagttctagacttttccaggtccgagggaactattaggggggaaagtacttgttatagtaaaaaagattttaggtgtgtttgtttttaaggtgcagaaacacatcgcagattaaggtctgcatctctgctttttgttattgttccagtttgatctcagtgacattacaagcaagcagaaacactcagacatgaaatggccagtgcctgtgagttaagagcaggatctaggtctatttttttgatatgtatctcaactacctggaatactttatacttttggcactcaataaatatttgttgctgccagacgatctgccacaaa

SEQ ID NO: 733054 - DNA, 478 bp, Homo sapiens
ggtttgtcttggtccattttatgctgctataacagaacaccacagactgagaaatttataaggaatagaagtttatttgcctcatgtttctggaggctgggaattccaagatcaaggggctgcatagattgaggtcctttttgctgactcataacgtggaaagagagtgcactgcatagaagaaaggaggccaaactcattcttttatcatgagcctactcctgaaataactcactctcaagataatggcattaatccattcatgaaggcagaatactcatgatgtaatcacctcttaaaagtttgatctcagtgacattacaagcaagcagaaacactcagacatgaaatggccagtgcctgtgagttaagagcaggatctaggtctatttttttgatatgtatctcaactacctggaatactttatacttttggcactcaataaatatttgttgctgccagacgatctgccacaaa

SEQ ID NO: 733055 - DNA, 769 bp, Homo sapiens
  misc_feature (766)..(766): n is a, c, g, or t
tgggtttgggggtgaataggctgggaaatttctgagccttttttttttgtcacagtgccctcaagttgaagtgatgagctggatttctttcttgttccatactgggcggcatgctcctcccatctccaccccttggtttgggggcttccagctcattggcaaaatctctctagttgccttcctttcaagctggagcctgacttttccccaatgtacattttttttttctccacaaagagttccttctctaatgtccccatctggtattaagtgcactttaaagaaaggggcagggtggattttcaagaggtgggaagctctaaggcttgaccgtgaggggtcttctcccagccattctcagcccatatgcagcaccctccatactgaagaggactgttgttttagtttcagacggtcctttccttccacatggtgctaaggtggttttctaggtaactgcagggatggaggtcactagccattccaaaccaggagagaaagtctggtgtcctgatatccagtcttttctaggaggaagaccaagattctccagcggcagggcagcctatcacccaacttctaagtcaggaaaggaagctgagtgggaatgccagctggtaagcgcaggctgcactggccccttcctcagaacaatggttttcaaactactccacagaatcctcagggtctcttaggactgttcaagggctcatttgctgaggagcctttgaacagtcagtcctaagagacgctgagacttcttccncca

SEQ ID NO: 733056 - DNA, 1241 bp, Homo sapiens
  misc_feature (1238)..(1238): n is a, c, g, or t
ggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcacggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagctgctgagctccttttagcagttagggagaactgcagggggaaaaataccagtggagtgtggaataaatccaaagcagtgatttttaaatgtttttcaaaaacaaatcttacatagaacccccttcctcagaacaatggttttcaaactactccacagaatcctcagggtctcttaggactgttcaagggctcatttgctgaggagcctttgaacagtcagtcctaagagacgctgagacttcttccncca

SEQ ID NO: 733057 - DNA, 2687 bp, Homo sapiens
ggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcacggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattccttgggtttgggggtgaataggctgggaaatttctgagccttttttttttgtcacagtgccctcaagttgaagtgatgagctggatttctttcttgttccatactgggcggcatgctcctcccatctccaccccttggtttgggggcttccagctcattggcaaaatctctctagttgccttcctttcaagctggagcctgacttttccccaatgtacattttttttttctccacaaagagttccttctctaatgtccccatctggtattaagtgcactttaaagaaaggggcagggtggattttcaagaggtgggaagctctaaggcttgaccgtgaggggtcttctcccagccattctcagcccatatgcagcaccctccatactgaagaggactgttgttttagtttcagacggtcctttccttccacatggtgctaaggtggttttctaggtaactgcagggatggaggtcactagccattccaaaccaggagagaaagtctggtgtcctgatatccagtcttttctaggaggaagaccaagattctccagcggcagggcagcctatcacccaacttctaagtcaggaaaggaagctgagtgggaatgccagctggtaagcgcaggctgcactggcccatgactccttcaaggaaaagaggccctgctccctttacctgctgagctccttttagcagttagggagaactgcagggggaaaaataccagtggagtgtggaataaatccaaagcagtgatttttaaatgtttttcaaaaacaaatcttacatagaaccccaatataaaaaataaagtaatgcagacctgggcagtttgca

SEQ ID NO: 733058 - DNA, 925 bp, Homo sapiens
tggatgtgtccagagaagatactgcccgtgcacgacggacacgaaccgggtgccatttgtcaagggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagag

SEQ ID NO: 733059 - DNA, 3011 bp, Homo sapiens
ggcgagtgttcaggttctagagctatgcagctggagcactgcctttctccttctatcatgctctccaagaaatttctcaatgtgagcagcagctacccacattcaggcggatccgagcttgtcttgcacgatcatcccattatctcgaccactgacaacctggagagaagttcacctttgaaaaaaattaccagggggatgacgaatcagtcagatacagacaattttcctgactccaaggactcaccaggggacgtccagagaagtaaactctctcctgtcttggacggggtctctgagcttcgtcacagtttcgatggctctgctgcagatcgctacctcctctctcagtccagccagccacagtctgcggccactgctcccagtgccatgttcccgtaccccggccagcacggaccggcgcaccccgccttctccatcggcagccctagccgctacatggcccaccacccggtcatcaccaacggagcctacaacagcctcctgtccaactcctcgccgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggcgcatgtttccttttttaagttttaacatttctggtctcgatcccacggctcattacaatatttttgtggatgtgattttggcggatcccaatcactggaggtttcaaggaggcaaatgggttccttgcggcaaagcggacaccaatgtgcaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctacccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttggttttcctacttactcttcttctgtggagttatcctcctacaattcccctccccctcgtctttctcttacctcctacttctctttcttgtaatgaaactcttcacctttaggagacctgggcagtcctgtcaggcagcagcgattccgacccgccaagtctcggcctccacattaaccataggatgttgactctagaacctggacccacccagcgcgtcctttcttatccccgagtggatggatggatggatggatggtagggatgttaataattttagtggaacaaagcctgtgaaatgattgtacatagtgttaatttattgtaacgaatggctagtttttattctcgtcaaggcacaaaaccagttcatgcttaacctttttttcctttcctttctttgcttttctttctctcctctcatactttctcttctctctcttttaattttcttgtgagataatattctaagaggctctagaaacatgaaatactcagtagtgatgggtttcccacttctcctcaatccgttgcatgaaataattactatgtgccctaatgcacacaaatagctaaggagaatccacccaaacacctttaaaggataggtgtctgttcataggcaagtcgattaagtggcatgatgcctgcaaagcaaagtcaactggagttgtatgttccccccaccttctaaatagaatagctcg

SEQ ID NO: 733060 - DNA, 1840 bp, Homo sapiens
attacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctacccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttggttttcctacttactcttcttctgtggagttatcctcctacaattcccctccccctcgtctttctcttacctcctacttctctttcttgtaatgaaactcttcacctttaggagacctgggcagtcctgtcaggcagcagcgattccgacccgccaagtctcggcctccacattaaccataggatgttgactctagaacctggacccacccagcgcgtcctttcttatccccgagtggatggatggatggatggatggtagggatgttaataattttagtggaacaaagcctgtgaaatgattgtacatagtgttaatttattgtaacgaatggctagtttttattctcgtcaaggcacaaaaccagttcatgcttaacctttttttcctttcctttctttgcttttctttctctcctctcatactttctcttctctctcttttaattttcttgtgagataatattctaagaggctctagaaacatgaaatactcagtagtgatgggtttcccacttctcctcaatccgttgcatgaaataattactatgtgccctaatgcacacaaatagctaaggagaatccacccaaacacctttaaaggataggtgtctgttcataggcaagtcgattaagtggcatgatgcctgcaaagcaaagtcaactggagttgtatgttccccccaccttctaaatagaatagctcg

SEQ ID NO: 733061 - DNA, 4518 bp, Homo sapiens
aggccgccagggcccaaaggacagcggcccagacaggggctggcggcccggccggccccggctcaccgactcgggcagcatccacctgccccagccaacacccttctctcgccccaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagtggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctga

SEQ ID NO: 733062 - DNA, 4539 bp, Homo sapiens
aggccgccagggcccaaaggacagcggcccagacaggggctggcggcccggccggccccggctcaccgactcgggcagcatccacctgccccagccaacacccttctctcgccccaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagtggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctgaaaaaaaaaacccccccccccc

SEQ ID NO: 733063 - DNA, 1047 bp, Homo sapiens
gcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctga

SEQ ID NO: 733064 - DNA, 322 bp, Homo sapiens
tgcaaacatcgagggcaatgccgagactgcacaggtgctgggcctcaccccctggatggactatgagttccgggtcatagccagcaacattctgggcactggggagcctagtgggccctccagcaaaatccggaccagggaagcaggtgagagtcctgtgtgtcccaaaaagctatcatcagggcagagaccctggcaccacttatagggaatgccaagccagccgcaattatgctgagttccaaccctgctcacagggttcagactctcacaaaacagaggaggacagaacaccaagttgggaccagggccactgcatgga

SEQ ID NO: 733065 - DNA, 1353 bp, Homo sapiens
aatgtgactttttagagatcaatgagatagtgcagatatacacagatctagagactccaggagacgatgcgacactcagcctgaaaagatttggaagacccaaaatgaaaactgattattgaatgaaattaaaacctaaggtaatttaagattagagaaccatgttaacactaccgtttgatgagtctgttgtaatgccagaatcccagatgtgcagaaagttttctagagaatgcgaggaccagaagcaaattaagaagccagaaagcttttccaaacagattgtccttcgaggaaagagcatcaaaagggcccctggagaagaaaccgagaaagaagaagaggaggaagacagggaagaggaagatgaaaatgggttgcctagaaggaggggtcttaggaaaaaaaagacaacaaagctgcgattggaaagggtcaagttcaggagacaggaagcgaacgcgcgcgagaggaacaggatgcacggcctcaacgacgctctggacaacttaagaaaagtggtcccctgttattctaaaacccagaaactgtccaaaatagagactttacgactggccaaaaactacatctgggcactttctgaaattctgagaatcggcaagagaccagatctgctcacattcgtccaaaacttatgcaaaggtctttcccagccaactacaaacttggtggcaggctgcttgcagctcaacgccagggagtttcctgatgggtcagggtggggaggctgcacaccacacaaggtcaccctactctaccttctacccaccctaccacagccctgagcttcaccactcccccagggcatgggactcttgataatttccaagtccatgaaaccctacaattatttgcagtgcgtatgaatccttctatgaaagtacttcccctgagtgtgccagccctcagtttgaaggtcccttaagtcctcccccaattaactataatgggatattttccctgaagcaagaagaaaccttggactatggtaaaaattacaattacggcatgcattactgtgcagtgccacccaggggtccccttgggcagggtgccatgttcaggttgcccaccgacagccacttcccttacgacttacatctgcgcagccaatctctcacaatgcaagatgaattaaatgcagtttttcataattaatgaggaaaatgaaaataaacagtggtcattcacctcccctgtctaattaagacaaagcagatgcttgtgggctgagtaattggcacaactctatctaaggtgtttactagtttctgaagtgtgtttcaactattgtgagaattttctatgtaataataaatctcttttcgtatg

SEQ ID NO: 733066 - DNA, 1975 bp, Homo sapiens
aatgtgactttttagagatcaatgagatagtgcagatatacacagatctagagactccaggagacgatgcgacactcagcctgaaaagatttggaagacccaaaatgaaaactgattattgaatgaaattaaaacctaaggtaatttaagattagagaaccatgttaacactaccgtttgatgagtctgttgtaatgccagaatcccagatgtgcagaaagttttctagagaatgcgaggaccagaagcaaattaagaagccagaaagcttttccaaacagattgtccttcgaggaaagagcatcaaaagggcccctggagaagaaaccgagaaagaagaagaggaggaagacagggaagaggaagatgaaaatgggttgcctagaaggaggggtcttaggaaaaaaaagacaacaaagctgcgattggaaagggtcaagttcaggagacaggaagcgaacgcgcgcgagaggaacaggatgcacggcctcaacgacgctctggacaacttaagaaaagtggtcccctgttattctaaaacccagaaactgtccaaaatagagactttacgactggccaaaaactacatctgggcactttctgaaattctgagaatcggcaagagaccagatctgctcacattcgtccaaaacttatgcaaaggtctttcccagccaactacaaacttggtggcaggctgcttgcagctcaacgccagggagtttcctgatgggtcagggtggggaggctgcacaccacacaaggtcaccctactctaccttctacccaccctaccacagccctgagcttcaccactcccccagggcatgggactcttgataatttccaagtccatgaaaccctacaattatttgcagtgcgtatgaatccttctatgaaagtacttcccctgagtgtgccagccctcagtttgaaggtcccttaagtcctcccccaattaactataatgggatattttccctgaagcaagaagaaaccttggactatggtaaaaattacaattacggcatgcattactgtgcagtgccacccaggggtccccttgggcagggtgccatgttcaggttgcccaccgacagccacttcccttacgacttacatctgcgcagccaatctctcacaatgcaagatgaattaaatgcagtttttcataattaatgaggaaaatgaaaataaacagtggtcattcacctcccctgtctaattaagacaaagcagatgcttgtgggctgagtaattggcacaactctatctaaggtgtttactagtttctgaagtgtgtttcaactattgtgagaattttctatgtaataataaatctcttttcgtatgagaacttcttttcctttccttttgtctgtgaagcactgtgattctgtttctactggaaagatttttttctttttaattttcttttaaacttatttaatttgtttgaacaaggtgtctaagaatatactgttgaataaagacatgcacacagcataattcaatgtctattttggttgtacagtaattataaaatgcatgttattaaaaccagatgagtaaaatgatgtgtttataattattaggaattatatattatgtatcttttaaaaattgaaattttaaaatatggagaatatcactaagctgacaatgatattgggagatgaatttgcaacaatataaaaagctatgcaattttctttttattaaggatgaatctaaatgcattcaattggtaactattcctcttcaagtatttgcagatggggcaacatgatatttgggtagctgatgtcataattcggggacaattatctcaatcatcaagaaaaaaatttcagcacttgttttgtattattcagaaattaactgtacaggtttgttatcacaatgtataattgtgtttttccaccccacatttttaaggcaattaaatatagatatttccactcgtaaaggacat

SEQ ID NO: 733067 - DNA, 2080 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733068 - DNA, 426 bp, Homo sapiens
taatgtcaaagtgaatgtctgaagttttgtctttttttctttgtccttttccatctgcttcattctgtggggataaaatacttgtgtttaatcagaacaacaactggaacgcattgaggaagggatggaccaaatcaataaggacatgaaagaagcagaaaagaatttgacggacctaggaaaattctgcgggctttgtgtgtgtccctgtaacaagtaggtgctgcctgcctgcctgaagctttgatttcccaaggcccatctccaagccttgacaagctcattcctgccaagctcataggcaggatgagcatgtggcatgcagaacagatcaataccgtctccaatgcattcatctcatagcatagatgatattagcaggagttactgttgatgcattaaaaatcaggcatactacagtgaaag

SEQ ID NO: 733069 - DNA, 2435 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggaaaaaaaaatattccacagggatctttgcatgatggtgtgtaaaaacttggttgaggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733070 - DNA, 549 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagtaggtactgggtaccagctctaatctgtggcgtccagttttctttct

SEQ ID NO: 733071 - DNA, 480 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccagttctggaaaggaagatgatacagaaaccacagccattttgcagatatgaaaactgggacatagaaatttgactgccctggaaaagatcacctacttatttgatgacagagccagttcagggatgaagatggagtcttgctctgtcacccaggctggagtacaatggcatggtcttggttccctgcaacctccacctcccaggttcaagcgattctcctgcctcagcctcatgagtagctgggattacaggcacgcgccaccaagcccaggtcactccagcagcacatgccaaaccaggatgagcaaagttcataagcttgctt

SEQ ID NO: 733072 - DNA, 2080 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733073 - DNA, 1889 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733074 - DNA, 1889 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733075 - DNA, 1687 bp, Homo sapiens
  misc_feature (11)..(11): n is a, c, g, or t
atcagctcggnccaagttagtgggacgcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733076 - DNA, 1496 bp, Homo sapiens
  misc_feature (11)..(11): n is a, c, g, or t
atcagctcggnccaagttagtgggacgcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733077 - DNA, 2039 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733078 - DNA, 1848 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733079 - DNA, 1981 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733080 - DNA, 1885 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733081 - DNA, 1694 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733082 - DNA, 1827 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733083 - DNA, 2022 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733084 - DNA, 1926 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733085 - DNA, 1735 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733086 - DNA, 1868 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733087 - DNA, 2022 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733088 - DNA, 1926 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733089 - DNA, 1735 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733090 - DNA, 1868 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733091 - DNA, 674 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagaggtaagaagtgacagtattttaagataaaggaacaaatcccttatgctgatacatcctttcctagttgctatgatgtttccttgggccatgatcccctagattccagtgtggatgtagcctatcagaaaggcacagaatgagggagatgctgtatttaagttgccagatagccatgaagacaccttcaccctccttcccagcccaagccacctctgtagtctggtctgggaagcagagaataatagaatttccaagtctgtgctctcaagaaatcacagacgattgtatcactttaagcaaattagagcaattcttaatatacaaaggaattatctacata

SEQ ID NO: 733092 - DNA, 1629 bp, Homo sapiens
  misc_feature (11)..(11): n is a, c, g, or t
atcagctcggnccaagttagtgggacgcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733093 - DNA, 1533 bp, Homo sapiens
  misc_feature (11)..(11): n is a, c, g, or t
atcagctcggnccaagttagtgggacgcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733094 - DNA, 1342 bp, Homo sapiens
  misc_feature (11)..(11): n is a, c, g, or t
atcagctcggnccaagttagtgggacgcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733095 - DNA, 1475 bp, Homo sapiens
  misc_feature (11)..(11): n is a, c, g, or t
atcagctcggnccaagttagtgggacgcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733096 - DNA, 2039 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733097 - DNA, 1848 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733098 - DNA, 1981 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733099 - DNA, 1885 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733100 - DNA, 1694 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733101 - DNA, 1827 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733102 - DNA, 2378 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733103 - DNA, 2187 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733104 - DNA, 2320 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733105 - DNA, 2224 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733106 - DNA, 2033 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733107 - DNA, 2166 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733108 - DNA, 2312 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733109 - DNA, 2121 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733110 - DNA, 2254 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733111 - DNA, 2158 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733112 - DNA, 1967 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733113 - DNA, 2100 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733114 - DNA, 1973 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733115 - DNA, 1782 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733116 - DNA, 1915 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733117 - DNA, 1819 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733118 - DNA, 1628 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733119 - DNA, 1761 bp, Homo sapiens
cggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733120 - DNA, 2014 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733121 - DNA, 1823 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733122 - DNA, 1956 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733123 - DNA, 1860 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733124 - DNA, 1669 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733125 - DNA, 1802 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733126 - DNA, 2014 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733127 - DNA, 1823 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733128 - DNA, 1956 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733129 - DNA, 1860 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733130 - DNA, 1669 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733131 - DNA, 1802 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733132 - DNA, 1927 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733133 - DNA, 1736 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733134 - DNA, 1869 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733135 - DNA, 1773 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733136 - DNA, 1582 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733137 - DNA, 1715 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733138 - DNA, 1861 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733139 - DNA, 1670 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733140 - DNA, 1803 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733141 - DNA, 1707 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733142 - DNA, 1516 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733143 - DNA, 1649 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733144 - DNA, 1787 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733145 - DNA, 1596 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733146 - DNA, 1729 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733147 - DNA, 1976 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733148 - DNA, 1785 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733149 - DNA, 1918 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733150 - DNA, 1822 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733151 - DNA, 1631 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733152 - DNA, 1764 bp, Homo sapiens
agcggggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733153 - DNA, 1621 bp, Homo sapiens
  misc_feature (11)..(11): n is a, c, g, or t
atcagctcggnccaagttagtgggacgcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733154 - DNA, 1430 bp, Homo sapiens
  misc_feature (11)..(11): n is a, c, g, or t
atcagctcggnccaagttagtgggacgcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733155 - DNA, 1563 bp, Homo sapiens
  misc_feature (11)..(11): n is a, c, g, or t
atcagctcggnccaagttagtgggacgcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733156 - DNA, 1467 bp, Homo sapiens
  misc_feature (11)..(11): n is a, c, g, or t
atcagctcggnccaagttagtgggacgcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733157 - DNA, 1276 bp, Homo sapiens
  misc_feature (11)..(11): n is a, c, g, or t
atcagctcggnccaagttagtgggacgcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 733158 - DNA, 1409 bp, Homo sapiens
  misc_feature (11)..(11): n is a, c, g, or t
atcagctcggnccaagttagtgggacgcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagatgatctgctttaattt

SEQ ID NO: 733159 - DNA, 256 bp, Homo sapiens
actgatttctctttctctcttttctctctctaactccttttcaactttgctaccattattggaatgagtaaagatgctggtatcaggactttggttatgttggatgaacaaggaggtaagttcagatttcttcagtaagaacaattcctcttctgaataatgtgcattttaaaattatttgtgcatacgcagatggtcgctttgacatgtgttacacatgtacacgaatgtgagggttctagatttttcatcttgc

SEQ ID NO: 733160 - DNA, 658 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtaggtgagtgcctccgcagccccgccgcccgccgtggggtcggggacagggagaagggagtgcctgcctggtctgcgccccccgcctgtcagcccttgcctcgaggctctggggcacccaactcgtcgactcctgacaccgcagcggggtaggctgctggacagccccgagcgcctgcagctgctgctgccatctctgatctacatgcttccagctctgccagtggcagcccccctgctgctcgcagtctgatcagcaacccctcgggtcctcgcatcttccctgctgcgcgctcctgtcccagcgcggccgcgagatt

SEQ ID NO: 733161 - DNA, 1490 bp, Homo sapiens
gccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggttgccggctgatgggcattcagcatggaggtggtgggtgttgttagatgtgtgtacacacgtgcatgcctacacacacaacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggagaggtgtggcctgctctggaggaagagaagaggaagtggagatgagtggtgtgtgggatagagaaggccacagaaccctggacccctgggttctgaggctggtaccggatgtggggaagtctgagtttcctcagggctcctagctgcaattgggaggctgaggcccgagactggagagacagagctctctcagaactgcacggggctaccctcttggcctcactggtcagtgactcccatttttggggtcaaggtaggttgccctccatgttccagagcagttaggtcctcattggccttaggccctcttccctcactctcccactgtcagacagaggtgaaagggtggtccagggtgttggccccaaatgactccaactatatgggtctctgggctgcccgtcagagagatgggagccaggtctgtgagcagctccagctccagcccagagagaagggagggagggcaccagaagggggccaggcccaggcctggcacagctcagatgcatggcaaacagtcttcccagcacccggtgggcactggctgctcctgcccaatggtccccactccagccccagaacagtcctcccaagcaccccaatgtctggagctggtctccgcacctctaatctggccccatcaagaacctcctccctctgaaaggtcagagagaggccctaagcatctggttgtgccactcctctcccaactctgaccctagggaatgatatccagacacagtgggggagatgggggttatgatggcagggaggtgggaggatctgggaaaagtaggaaatttcccatcatctcaggcttaggaaagtgcagggacaggtatgaaggcagatgctgagagggcagggaagatgggggataaacagtgggcctggaatgggagtgcacagccagtggaataaacctgatctctaggaagtcctgcctgtagtctaaccttcaattctcttgct

SEQ ID NO: 733162 - DNA, 729 bp, Homo sapiens
accacgcgtcgccacgcgtcgccacgcgtgcccacgcgtcggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733163 - DNA, 3525 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733164 - DNA, 3474 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733165 - DNA, 3796 bp, Homo sapiens
  misc_feature (3501)..(3501): n is a, c, g, or t
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733166 - DNA, 3364 bp, Homo sapiens
ttatatcgtgaccgacgccgtcgccacgcggtcggcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733167 - DNA, 3313 bp, Homo sapiens
ttatatcgtgaccgacgccgtcgccacgcggtcggcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733168 - DNA, 3635 bp, Homo sapiens
  misc_feature (3340)..(3340): n is a, c, g, or t
ttatatcgtgaccgacgccgtcgccacgcggtcggcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733169 - DNA, 2934 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctggg

SEQ ID NO: 733170 - DNA, 2871 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaacca

SEQ ID NO: 733171 - DNA, 3361 bp, Homo sapiens
accacgcgtcgccacgcgtcgccacgcgtgcccacgcgtcgccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733172 - DNA, 3310 bp, Homo sapiens
accacgcgtcgccacgcgtcgccacgcgtgcccacgcgtcgccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733173 - DNA, 3632 bp, Homo sapiens
  misc_feature (3337)..(3337): n is a, c, g, or t
accacgcgtcgccacgcgtcgccacgcgtgcccacgcgtcgccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733174 - DNA, 2770 bp, Homo sapiens
accacgcgtcgccacgcgtcgccacgcgtgcccacgcgtcgccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctggg

SEQ ID NO: 733175 - DNA, 2707 bp, Homo sapiens
accacgcgtcgccacgcgtcgccacgcgtgcccacgcgtcgccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaacca

SEQ ID NO: 733176 - DNA, 2773 bp, Homo sapiens
ttatatcgtgaccgacgccgtcgccacgcggtcggcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctggg

SEQ ID NO: 733177 - DNA, 2710 bp, Homo sapiens
ttatatcgtgaccgacgccgtcgccacgcggtcggcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaacca

SEQ ID NO: 733178 - DNA, 880 bp, Homo sapiens
ctctagagatccccccccgactagcccgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733179 - DNA, 829 bp, Homo sapiens
ctctagagatccccccccgactagcccgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733180 - DNA, 1151 bp, Homo sapiens
  misc_feature (856)..(856): n is a, c, g, or t
ctctagagatccccccccgactagcccgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733181 - DNA, 4651 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733182 - DNA, 4600 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733183 - DNA, 4922 bp, Homo sapiens
  misc_feature (4627)..(4627): n is a, c, g, or t
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733184 - DNA, 4487 bp, Homo sapiens
accacgcgtcgccacgcgtcgccacgcgtgcccacgcgtcgccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733185 - DNA, 4436 bp, Homo sapiens
accacgcgtcgccacgcgtcgccacgcgtgcccacgcgtcgccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733186 - DNA, 4758 bp, Homo sapiens
  misc_feature (4463)..(4463): n is a, c, g, or t
accacgcgtcgccacgcgtcgccacgcgtgcccacgcgtcgccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733187 - DNA, 1499 bp, Homo sapiens
ctccattgtggggctgggttctcaggctctcctagcctcttctccccagccccttttgggctgggctcacactggtggccataacaatggaaggctgagccaatgctgaagtcgggagcgggaagaggaaagaaacccagaactcagggctgggttgtgaccagagacaggctctagggagaacttttagggtgctgttatagcttccaggacagagagaccagggctgggggaccctctgcaccctctcctggagggctcaggctgcagagtgcggctgcctcgctccccccgcctcacttctttccccctctcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733188 - DNA, 1550 bp, Homo sapiens
ctccattgtggggctgggttctcaggctctcctagcctcttctccccagccccttttgggctgggctcacactggtggccataacaatggaaggctgagccaatgctgaagtcgggagcgggaagaggaaagaaacccagaactcagggctgggttgtgaccagagacaggctctagggagaacttttagggtgctgttatagcttccaggacagagagaccagggctgggggaccctctgcaccctctcctggagggctcaggctgcagagtgcggctgcctcgctccccccgcctcacttctttccccctctcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733189 - DNA, 1821 bp, Homo sapiens
  misc_feature (1526)..(1526): n is a, c, g, or t
ctccattgtggggctgggttctcaggctctcctagcctcttctccccagccccttttgggctgggctcacactggtggccataacaatggaaggctgagccaatgctgaagtcgggagcgggaagaggaaagaaacccagaactcagggctgggttgtgaccagagacaggctctagggagaacttttagggtgctgttatagcttccaggacagagagaccagggctgggggaccctctgcaccctctcctggagggctcaggctgcagagtgcggctgcctcgctccccccgcctcacttctttccccctctcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733190 - DNA, 4490 bp, Homo sapiens
ttatatcgtgaccgacgccgtcgccacgcggtcggcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733191 - DNA, 4439 bp, Homo sapiens
ttatatcgtgaccgacgccgtcgccacgcggtcggcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733192 - DNA, 4761 bp, Homo sapiens
  misc_feature (4466)..(4466): n is a, c, g, or t
ttatatcgtgaccgacgccgtcgccacgcggtcggcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733193 - DNA, 597 bp, Homo sapiens
gagaggagaaggaagagccagggtggagggtgagtgtgtgtcttccccaggcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733194 - DNA, 3361 bp, Homo sapiens
  misc_feature (32)..(33): n is a, c, g, or t
ctgtcggccggaagtattggattgtcgacccnncgtcgcgtccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733195 - DNA, 3310 bp, Homo sapiens
  misc_feature (32)..(33): n is a, c, g, or t
ctgtcggccggaagtattggattgtcgacccnncgtcgcgtccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733196 - DNA, 3632 bp, Homo sapiens
  misc_feature (32)..(33): n is a, c, g, or t
  misc_feature (3337)..(3337): n is a, c, g, or t
ctgtcggccggaagtattggattgtcgacccnncgtcgcgtccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733197 - DNA, 2770 bp, Homo sapiens
  misc_feature (32)..(33): n is a, c, g, or t
ctgtcggccggaagtattggattgtcgacccnncgtcgcgtccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctggg

SEQ ID NO: 733198 - DNA, 4487 bp, Homo sapiens
  misc_feature (32)..(33): n is a, c, g, or t
ctgtcggccggaagtattggattgtcgacccnncgtcgcgtccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733199 - DNA, 4436 bp, Homo sapiens
  misc_feature (32)..(33): n is a, c, g, or t
ctgtcggccggaagtattggattgtcgacccnncgtcgcgtccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733200 - DNA, 4758 bp, Homo sapiens
  misc_feature (32)..(33): n is a, c, g, or t
  misc_feature (4463)..(4463): n is a, c, g, or t
ctgtcggccggaagtattggattgtcgacccnncgtcgcgtccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733201 - DNA, 2707 bp, Homo sapiens
  misc_feature (32)..(33): n is a, c, g, or t
ctgtcggccggaagtattggattgtcgacccnncgtcgcgtccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaacca

SEQ ID NO: 733202 - DNA, 1522 bp, Homo sapiens
  misc_feature (95)..(95): n is a, c, g, or t
  misc_feature (98)..(98): n is a, c, g, or t
  misc_feature (104)..(105): n is a, c, g, or t
  misc_feature (108)..(109): n is a, c, g, or t
  misc_feature (112)..(112): n is a, c, g, or t
  misc_feature (114)..(114): n is a, c, g, or t
  misc_feature (116)..(116): n is a, c, g, or t
tggaggaactgcagctgcctcaggttctctgtcactgtgacgatagcctctagtccatcagaggctgggttggaggctgggttggaggcctcagnganggagannctnngcngngnctcggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctggg

SEQ ID NO: 733203 - DNA, 2062 bp, Homo sapiens
  misc_feature (95)..(95): n is a, c, g, or t
  misc_feature (98)..(98): n is a, c, g, or t
  misc_feature (104)..(105): n is a, c, g, or t
  misc_feature (108)..(109): n is a, c, g, or t
  misc_feature (112)..(112): n is a, c, g, or t
  misc_feature (114)..(114): n is a, c, g, or t
  misc_feature (116)..(116): n is a, c, g, or t
tggaggaactgcagctgcctcaggttctctgtcactgtgacgatagcctctagtccatcagaggctgggttggaggctgggttggaggcctcagnganggagannctnngcngngnctcggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733204 - DNA, 2113 bp, Homo sapiens
  misc_feature (95)..(95): n is a, c, g, or t
  misc_feature (98)..(98): n is a, c, g, or t
  misc_feature (104)..(105): n is a, c, g, or t
  misc_feature (108)..(109): n is a, c, g, or t
  misc_feature (112)..(112): n is a, c, g, or t
  misc_feature (114)..(114): n is a, c, g, or t
  misc_feature (116)..(116): n is a, c, g, or t
tggaggaactgcagctgcctcaggttctctgtcactgtgacgatagcctctagtccatcagaggctgggttggaggctgggttggaggcctcagnganggagannctnngcngngnctcggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733205 - DNA, 2384 bp, Homo sapiens
  misc_feature (95)..(95): n is a, c, g, or t
  misc_feature (98)..(98): n is a, c, g, or t
  misc_feature (104)..(105): n is a, c, g, or t
  misc_feature (108)..(109): n is a, c, g, or t
  misc_feature (112)..(112): n is a, c, g, or t
  misc_feature (114)..(114): n is a, c, g, or t
  misc_feature (116)..(116): n is a, c, g, or t
  misc_feature (2089)..(2089): n is a, c, g, or t
tggaggaactgcagctgcctcaggttctctgtcactgtgacgatagcctctagtccatcagaggctgggttggaggctgggttggaggcctcagnganggagannctnngcngngnctcggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733206 - DNA, 3239 bp, Homo sapiens
  misc_feature (95)..(95): n is a, c, g, or t
  misc_feature (98)..(98): n is a, c, g, or t
  misc_feature (104)..(105): n is a, c, g, or t
  misc_feature (108)..(109): n is a, c, g, or t
  misc_feature (112)..(112): n is a, c, g, or t
  misc_feature (114)..(114): n is a, c, g, or t
  misc_feature (116)..(116): n is a, c, g, or t
tggaggaactgcagctgcctcaggttctctgtcactgtgacgatagcctctagtccatcagaggctgggttggaggctgggttggaggcctcagnganggagannctnngcngngnctcggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733207 - DNA, 3188 bp, Homo sapiens
  misc_feature (95)..(95): n is a, c, g, or t
  misc_feature (98)..(98): n is a, c, g, or t
  misc_feature (104)..(105): n is a, c, g, or t
  misc_feature (108)..(109): n is a, c, g, or t
  misc_feature (112)..(112): n is a, c, g, or t
  misc_feature (114)..(114): n is a, c, g, or t
  misc_feature (116)..(116): n is a, c, g, or t
tggaggaactgcagctgcctcaggttctctgtcactgtgacgatagcctctagtccatcagaggctgggttggaggctgggttggaggcctcagnganggagannctnngcngngnctcggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733208 - DNA, 3510 bp, Homo sapiens
  misc_feature (95)..(95): n is a, c, g, or t
  misc_feature (98)..(98): n is a, c, g, or t
  misc_feature (104)..(105): n is a, c, g, or t
  misc_feature (108)..(109): n is a, c, g, or t
  misc_feature (112)..(112): n is a, c, g, or t
  misc_feature (114)..(114): n is a, c, g, or t
  misc_feature (116)..(116): n is a, c, g, or t
  misc_feature (3215)..(3215): n is a, c, g, or t
tggaggaactgcagctgcctcaggttctctgtcactgtgacgatagcctctagtccatcagaggctgggttggaggctgggttggaggcctcagnganggagannctnngcngngnctcggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733209 - DNA, 1459 bp, Homo sapiens
  misc_feature (95)..(95): n is a, c, g, or t
  misc_feature (98)..(98): n is a, c, g, or t
  misc_feature (104)..(105): n is a, c, g, or t
  misc_feature (108)..(109): n is a, c, g, or t
  misc_feature (112)..(112): n is a, c, g, or t
  misc_feature (114)..(114): n is a, c, g, or t
  misc_feature (116)..(116): n is a, c, g, or t
tggaggaactgcagctgcctcaggttctctgtcactgtgacgatagcctctagtccatcagaggctgggttggaggctgggttggaggcctcagnganggagannctnngcngngnctcggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaacca

SEQ ID NO: 733210 - DNA, 4264 bp, Homo sapiens
gccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggttgccggctgatgggcattcagcatggaggtggtgggtgttgttagatgtgtgtacacacgtgcatgcctacacacacaacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733211 - DNA, 4315 bp, Homo sapiens
gccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggttgccggctgatgggcattcagcatggaggtggtgggtgttgttagatgtgtgtacacacgtgcatgcctacacacacaacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733212 - DNA, 4586 bp, Homo sapiens
  misc_feature (4291)..(4291): n is a, c, g, or t
gccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggttgccggctgatgggcattcagcatggaggtggtgggtgttgttagatgtgtgtacacacgtgcatgcctacacacacaacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733213 - DNA, 3724 bp, Homo sapiens
gccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggttgccggctgatgggcattcagcatggaggtggtgggtgttgttagatgtgtgtacacacgtgcatgcctacacacacaacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctggg

SEQ ID NO: 733214 - DNA, 5441 bp, Homo sapiens
gccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggttgccggctgatgggcattcagcatggaggtggtgggtgttgttagatgtgtgtacacacgtgcatgcctacacacacaacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733215 - DNA, 5390 bp, Homo sapiens
gccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggttgccggctgatgggcattcagcatggaggtggtgggtgttgttagatgtgtgtacacacgtgcatgcctacacacacaacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733216 - DNA, 5712 bp, Homo sapiens
  misc_feature (5417)..(5417): n is a, c, g, or t
gccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggttgccggctgatgggcattcagcatggaggtggtgggtgttgttagatgtgtgtacacacgtgcatgcctacacacacaacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733217 - DNA, 3661 bp, Homo sapiens
gccctaaggccctgcttatattgtgtaggctcatgttgctcctcatgaagccgttaagggggtagcagagagcttccctcctgctatagccaaagctctggcttcttgtgcctccctgctgaccctgctgagtgctggagctcagttcctatgggacagaccttggttgccggctgatgggcattcagcatggaggtggtgggtgttgttagatgtgtgtacacacgtgcatgcctacacacacaacacacacacacagagagagagagagagagagagagagagagagagagacctggtcttaactctctgggttgggtctatgaagactgtgagggagatggacatcccgggtcagacagaaatgatgtgacaagaggaaagtttcctgaacagctcaagaaattcaaaacaagggcagagatacagacgctggagctgaaacagagagggggatgttgtggcgtcaagggaacggaccgcatgactgctgagctctcagggttagagttggaggaagtagaggagagggtgggctcaggagaagctgtgcttacttgcgttcggtctaggaggccctcctggaaaaggccaggtgagtatggtgtccctggaggcagggacagtctagaaggcagaagaggctaaagagatactatgggagaaggctctgggttcgaggaaggagtctggcactgggaggagcagatggaattctgagtataagagcacccaccattcatgctgtaaactgagctcctactgtctgcctggtgctatgcatttgtacaggagttttaagatactaaacactctcaaagcacatggtcctatctcaactcatgagatagtaatgatgatgcttttttataagtaagaaaataaaggctcagagaaggtaaggagcttggcttaggtcacacagtgagttgactaggactcgggttttggttctgagaagaaatcacttgctgggaagatggggatcagaaacagagagtccatggtgatgtgaaggtaggggacttctggagccaggatatgtgtgaacccacatgggtgtggtagggagcaggggggaagtccatcctgaagtctaaccccatctttccttctcatgtccctctgtcagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaacca

SEQ ID NO: 733218 - DNA, 1451 bp, Homo sapiens
ccagcctctcctcacgctcgcgcagtctccgccgcagtctcagctgcagctgcaggactgagccgtgcacccggaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733219 - DNA, 1502 bp, Homo sapiens
ccagcctctcctcacgctcgcgcagtctccgccgcagtctcagctgcagctgcaggactgagccgtgcacccggaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733220 - DNA, 1773 bp, Homo sapiens
  misc_feature (1478)..(1478): n is a, c, g, or t
ccagcctctcctcacgctcgcgcagtctccgccgcagtctcagctgcagctgcaggactgagccgtgcacccggaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733221 - DNA, 2298 bp, Homo sapiens
ccagcctctcctcacgctcgcgcagtctccgccgcagtctcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733222 - DNA, 2349 bp, Homo sapiens
ccagcctctcctcacgctcgcgcagtctccgccgcagtctcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733223 - DNA, 2620 bp, Homo sapiens
  misc_feature (2325)..(2325): n is a, c, g, or t
ccagcctctcctcacgctcgcgcagtctccgccgcagtctcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733224 - DNA, 1720 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733225 - DNA, 3213 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733226 - DNA, 3264 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733227 - DNA, 3535 bp, Homo sapiens
  misc_feature (3240)..(3240): n is a, c, g, or t
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733228 - DNA, 3209 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733229 - DNA, 3260 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733230 - DNA, 3531 bp, Homo sapiens
  misc_feature (3236)..(3236): n is a, c, g, or t
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733231 - DNA, 1779 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaacca

SEQ ID NO: 733232 - DNA, 2662 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggccctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctggg

SEQ ID NO: 733233 - DNA, 3202 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggccctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733234 - DNA, 3253 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggccctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733235 - DNA, 3524 bp, Homo sapiens
  misc_feature (3229)..(3229): n is a, c, g, or t
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggccctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733236 - DNA, 4379 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggccctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733237 - DNA, 4328 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggccctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733238 - DNA, 4650 bp, Homo sapiens
  misc_feature (4355)..(4355): n is a, c, g, or t
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggccctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733239 - DNA, 2599 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggccctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaacca

SEQ ID NO: 733240 - DNA, 3525 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttaggtggaggacattctacccacaatctaacttaagtccctcatgctgtagactctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733241 - DNA, 3576 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttaggtggaggacattctacccacaatctaacttaagtccctcatgctgtagactctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733242 - DNA, 3847 bp, Homo sapiens
  misc_feature (3552)..(3552): n is a, c, g, or t
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttaggtggaggacattctacccacaatctaacttaagtccctcatgctgtagactctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733243 - DNA, 2985 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttaggtggaggacattctacccacaatctaacttaagtccctcatgctgtagactctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctggg

SEQ ID NO: 733244 - DNA, 3264 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttaggtggaggacattctacccacaatctaacttaagtccctcatgctgtagactctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733245 - DNA, 3315 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttaggtggaggacattctacccacaatctaacttaagtccctcatgctgtagactctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733246 - DNA, 3586 bp, Homo sapiens
  misc_feature (3291)..(3291): n is a, c, g, or t
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttaggtggaggacattctacccacaatctaacttaagtccctcatgctgtagactctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733247 - DNA, 4702 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttaggtggaggacattctacccacaatctaacttaagtccctcatgctgtagactctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733248 - DNA, 4651 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttaggtggaggacattctacccacaatctaacttaagtccctcatgctgtagactctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733249 - DNA, 4973 bp, Homo sapiens
  misc_feature (4678)..(4678): n is a, c, g, or t
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttaggtggaggacattctacccacaatctaacttaagtccctcatgctgtagactctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggtgagtgttgagggacggggggcaggtttgaagcctggaccctgccacaacgtgctacttctggaggggggagggagaacattggttttggccttgtcattaatgagtccctgttttaggcaagttgcataacttctttgagtcctaccctcaattttcttatctaagtgaaaccacaatgcctctcatagggggtccatttgagaccagtgcaaagcatactcctggcatttaatcggtggtcaatacatgacaggctccattctcctggagaggagagccactgctcgttaggatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccccgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggttcgcgcagtagagtgcgcctgtgtgggccgggccgccgtgcagggggccgcctccaatccctccaacctccctgctctccgacctccgtcggcctcctccaactccaactccaatcttgttgaaagttttgactctttttccaaaactccccttttctagcctgggttgatatcttccttattctcccacccccattcccctgctttccatctggcccttgagcagaggctggggtagaagaacccgacaagggcgggtgctggatcgcggggaagggtttccaaggcagtcaccgcagaccgcccgggagcggggaacggccgccatctgctggcggctgcgctcactgcacgccttcgtctccctagaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733250 - DNA, 3260 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttaggtggaggacattctacccacaatctaacttaagtccctcatgctgtagactctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733251 - DNA, 3311 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttaggtggaggacattctacccacaatctaacttaagtccctcatgctgtagactctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733252 - DNA, 3582 bp, Homo sapiens
  misc_feature (3287)..(3287): n is a, c, g, or t
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttaggtggaggacattctacccacaatctaacttaagtccctcatgctgtagactctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733253 - DNA, 2922 bp, Homo sapiens
cctacttcgctcgtccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttaggtggaggacattctacccacaatctaacttaagtccctcatgctgtagactctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaacca

SEQ ID NO: 733254 - DNA, 1556 bp, Homo sapiens
  misc_feature (32)..(33): n is a, c, g, or t
ctgtcggccggaagtattggattgtcgacccnncgtcgcgtccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733255 - DNA, 3049 bp, Homo sapiens
  misc_feature (32)..(33): n is a, c, g, or t
ctgtcggccggaagtattggattgtcgacccnncgtcgcgtccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733256 - DNA, 3100 bp, Homo sapiens
  misc_feature (32)..(33): n is a, c, g, or t
ctgtcggccggaagtattggattgtcgacccnncgtcgcgtccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733257 - DNA, 3371 bp, Homo sapiens
  misc_feature (32)..(33): n is a, c, g, or t
  misc_feature (3076)..(3076): n is a, c, g, or t
ctgtcggccggaagtattggattgtcgacccnncgtcgcgtccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccagaaagaaaaaaaagaaacaacaaaanaaaaccaaaaacaaaaaaagggggcgccccccaaaaaaacaccccccgggggaccccaaagtagcgacccccactttttttgcaaaggggggcccccacaagagggcagcacgattataaaagaccggcgccggccaccgaggcataaaacaccgcggtgtgtgggaacaacgcgtgccagtggaacatctgcgggaggaaccaccactgcgagggcgggaaaaatgggcacgacacacgcgaaaattagcccacgcgaacacaggggacttaacgcacacaggacagaggccgg

SEQ ID NO: 733258 - DNA, 3045 bp, Homo sapiens
  misc_feature (32)..(33): n is a, c, g, or t
ctgtcggccggaagtattggattgtcgacccnncgtcgcgtccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccc

SEQ ID NO: 733259 - DNA, 3096 bp, Homo sapiens
  misc_feature (32)..(33): n is a, c, g, or t
ctgtcggccggaagtattggattgtcgacccnncgtcgcgtccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccccaaaaaaaacacaaaacaaaaaaaaaaaaaaaaaaaaaaaacaaaaaaaaa

SEQ ID NO: 733260 - DNA, 1596 bp, Homo sapiens; identical to SEQ ID NO: 87837
  misc_feature (6)..(6): n is a, c, g, or t
  misc_feature (1486)..(1486): n is a, c, g, or t

SEQ ID NO: 733261 - DNA, 3345 bp, Homo sapiens
  misc_feature (2369)..(2369): n is a, c, g, or t
tcccagccggctgaggcgggcagggccgggcggggccgcgccacggagtccacagcccggcgctccctgccgcgccgccgccgcaccgcgccccacaggagaagacgaaccgggcccggcggccgaagcggcccgcgaggcgcgggaggcatgaagttgggcgcgcacgggcctcgaagcggcggggagccgggagccgcccgcatctagagcccgcgaggtgcgtgcgccatggagctagggggccccggagcgccgcggctgctgccgccgctgctgctgcttctggggaccggcctcctgcgcgccagcagccatgtggagacccgggcccacgccgaggagcggctcctgaagaaactcttctccggttacaacaagtggtcccgacccgtggccaacatctcggacgtggtcctcgtccgcttcggcctgtccatcgctcagctcattgacgtggatgagaagaaccagatgatgaccacgaacgtatgggtgaagcaggagtggcacgactacaagctgcgctgggacccagctgactatgagaatgtcacctccatccgcatcccctccgagctcatctggcggccggacatcgtcctctacaacaatgctgacggggacttcgcggtcacccacctgaccaaggcccacctgttccatgacgggcgggtgcagtggactcccccggccatttacaagagctcctgcagcatcgacgtcaccttcttccccttcgaccagcagaactgcaccatgaaattcggctcctggacctacgacaaggccaagatcgacctggtgaacatgcacagccgcgtggaccagctggacttctgggagagtggcgagtgggtcatcgtggacgccgtgggcacctacaacaccaggaagtacgagtgctgcgccgagatctacccggacatcacctatgccttcgtcatccggcggctgccgctcttctacaccatcaacctcatcatcccctgcctgctcatctcctgcctcaccgtgctggtcttctacctgccctccgagtgtggcgagaagatcacgctgtgcatctccgtgctgctgtcgctcaccgtcttcctgctgctcatcaccgagatcatcccgtccacctcactggtcatcccactcatcggcgagtacctgctgttcaccatgatcttcgtcaccctgtccatcgtcatcacggtcttcgtgctcaacgtgcaccaccgctcgccacgcacgcacaccatgcccacctgggtacgcagggtcttcctggacatcgtgccacgcctgctcctcatgaagcggccgtccgtggtcaaggacaattgccggcggctcatcgagtccatgcataagatggccagtgccccgcgcttctggcccgagccagaaggggagccccctgccacgagcggcacccagagcctgcacccgccctcaccgtccttctgcgtccccctggatgtgccggctgagcctgggccttcctgcaagtcaccctccgaccagctccctcctcagcagcccctggaagctgagaaagccagcccccacccctcgcctggaccctgccgcccgccccacggcacccaggcaccagggctggccaaagccaggtccctcagcgtccagcacatgtccagccctggcgaagcggtggaaggcggcgtccggtgccggtctcggagcatccagtactgtgttccccgagacgatgccgcccccgaggcagatggccaggctgccggcgccctggcctctcgcaacacccactcggctgagctcccacccccagaccagccctctccgtgcaaatgcacatgcaagaaggagccctcttcggtgtccccgagcgccacggtcaagacccgcagcaccaaagcgccgcccccgcacctgcccctgtcgccggccctgacccgggcggtggagggcgtccagtacattgcagaccacctgaaggccgaagacacagacttctcggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctgtaagacggccttggacggggacacggcctctggggagaccgagtgtggagctgcttccagttggactgtggcctcaggaggcagtggcttggagcagaggtgggggtcgncgccttctacctgcaggactcgggctaagtccagctctccccctgcgcaggccctccgcggcggacaggaacacccagccccagcgagtctggagaccaggactctgccttccaggcgtagggccagggctctggcaggtggccagggctccacgggggcctagtggcttcagcccctggggtacttctgtgttgtgattccccggagctgggaaggtcccgaatggagtccagacctgggccctggttcccccaggaccctgagggtttccaccttggcgcgcagcccgggagatccgccctgggctctgggttcgggaagaaggacttcctgctacagtagctgtggggagctggtgggggcatccttgaggacctccacctgggagatgctgggaccctcggggcaggaagtccctgagaagcctcatgggagtcagggagccctggggtttccacacaggcccatgccctccgtcctggcagggcaggcagagctcagcacagcctcacccctgcaggcggtatccagaggtgagggaggcctgaaatgtttccaggcatgaccctggagcccggcagtgcaccccctaaagatggcgcacccggcagccccccattgtccccaggggcacacttcccccttgggatgggcacagcctgccccacccctccatgattccaagggccaagaggggcggggccaggatggcttttcccctgcctgtgagtgacatcggttcaggaggagacagtcaggaagcctcctgctgagtggtccacattctgctgcccccagaccccatccagccaggggtggggatggggttgggctctgcgtcccactgagtctcattcctctgtccccgagccgagctctcctgggccagggtctcgtcaggaggtgcctgagagcagaatgaataattgaggttaggaacccggcatgccgagtgccccagaaatgccgctgtgt

SEQ ID NO: 733262 - DNA, 434 bp, Homo sapiens; identical to SEQ ID NO: 87842
  misc_feature (11)..(14): n is a, c, g, or t
  misc_feature (16)..(16): n is a, c, g, or t
  misc_feature (51)..(51): n is a, c, g, or t
  misc_feature (316)..(316): n is a, c, g, or t

SEQ ID NO: 733263 - DNA, 411 bp, Homo sapiens; identical to SEQ ID NO: 87838

SEQ ID NO: 733264 - DNA, 1965 bp, Homo sapiens
  misc_feature (454)..(454): n is a, c, g, or t
  misc_feature (731)..(731): n is a, c, g, or t
  misc_feature (742)..(743): n is a, c, g, or t
ggcgccggggtcctgagggctgtcccgctggcggcggccgggccgtgctggagtgacggcgtctgtgcttgcaggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctgtaagacggccttggacggggacacggcctctggggagaccgagtgtggagctgcttccagttggactgtggcctcaggaggcagtggcttggagcagaggtgggggtcgncgccttctacctgcaggactcgggctaagtccagttcaagagtctcctgagctcccctgcagatggaactcactcctcccagtctctcagcagatctggtgatggtcccgaccgcaaggggcccttgaagggagttcacgccccttcagccccaagcgccccgtcttctggaggcccggccgcctctcccacccaccgtgtcctgcgcctgtgtgggcttcaacttctcccccagggtccttgagcctctcgggccccatgagggtgagccagcagngctccaatctnnttcgctaggagagggtccaggcagggattgtgtttggttgtgttttgggtaagttagtgagaactcaagtcttgtgcctaaggagccttggagaacagagttttgtggagctggttccgcgtggggagaatcgggaggcccacgcgggaccaggctctccccctgcgcaggccctccgcggcggacaggaacacccagccccagcgagtctggagaccaggactctgccttccaggcgtagggccagggctctggcaggtggccagggctccacgggggcctagtggcttcagcccctggggtacttctgtgttgtgattccccggagctgggaaggtcccgaatggagtccagacctgggccctggttcccccaggaccctgagggtttccaccttggcgcgcagcccgggagatccgccctgggctctgggttcgggaagaaggacttcctgctacagtagctgtggggagctggtgggggcatccttgaggacctccacctgggagatgctgggaccctcggggcaggaagtccctgagaagcctcatgggagtcagggagccctggggtttccacacaggcccatgccctccgtcctggcagggcaggcagagctcagcacagcctcacccctgcaggcggtatccagaggtgagggaggcctgaaatgtttccaggcatgaccctggagcccggcagtgcaccccctaaagatggcgcacccggcagccccccattgtccccaggggcacacttcccccttgggatgggcacagcctgccccacccctccatgattccaagggccaagaggggcggggccaggatggcttttcccctgcctgtgagtgacatcggttcaggaggagacagtcaggaagcctcctgctgagtggtccacattctgctgcccccagaccccatccagccaggggtggggatggggttgggctctgcgtcccactgagtctcattcctctgtccccgagccgagctctcctgggccagggtctcgtcaggaggtgcctgagagcagaatgaataattgaggttaggaacccggcatgccgagtgccccagaaatgccgctgtgtccccgcgggcagtgacgtgagtggggaggagactcaggcccacattgcccacacctgcctctgaactgctgctggtcacccccacccccgggtgcctgtgaccggggtcctgaggctggggctttt

SEQ ID NO: 733265 - DNA, 457 bp, Homo sapiens
ggagatgtttgtggccttgtccccacatccctaggtcccctcagagtccccatcctgggctcggctgcctccagggacggggcactcaccccctccacaggtcgcccgtccaccatatcttgccctggccgtgtccttgtgccagtggctgtagatgaggaaacctagggccagagaaagacaccaaggggtcactggcccccttcctctctcggtgccctaggatgagaagaaccagatgatgaccacgaacgtatgggtgaagcaggtgagtgggagggcactgcctgccccacccctgccctcccccacacccctcaccctgctgccctgtcctggccctgccccaccctggccctgctgagaactcaagtcttgtgcctaaggagccttggagaacagagttttgtggagctggttccgcgtggggagaatcgggaggcccacgcgggaccag

SEQ ID NO: 733266 - DNA, 924 bp, Homo sapiens
  misc_feature (8)..(8): n is a, c, g, or t
  misc_feature (75)..(75): n is a, c, g, or t
  misc_feature (90)..(90): n is a, c, g, or t
  misc_feature (99)..(99): n is a, c, g, or t
  misc_feature (101)..(101): n is a, c, g, or t
  misc_feature (104)..(104): n is a, c, g, or t
  misc_feature (122)..(122): n is a, c, g, or t
  misc_feature (158)..(163): n is a, c, g, or t
  misc_feature (166)..(166): n is a, c, g, or t
  misc_feature (736)..(736): n is a, c, g, or t
  misc_feature (784)..(784): n is a, c, g, or t
  misc_feature (865)..(865): n is a, c, g, or t
tctgaatncccaccctgcgactgttggttctgcatcagcaaacgctgaggagtgggcagattttctttgtctttngcttgcattttctanatccacacntnganactgcccatgttgacganacagcagcagggggagagggagggaaggaaggtgcnnnnnnaanaaggaaggcacggaacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatngctcaaactatcctgccaaacgctctcatctgatttttcctcccttcnccccaaacctccaatcaccctgagtcacctgtaaattcatttgtcattcaaagcggaataacaagttgtccctagcaaaancgctgagcgctttataattttgtggtgtatttttgtcagtaggtagcagaggcggaagt

SEQ ID NO: 733267 - DNA, 909 bp, Homo sapiens
  misc_feature (709)..(709): n is a, c, g, or t
  misc_feature (909)..(909): n is a, c, g, or t
gcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagcaaaaaaaaaaaaaaaaaaaaaaaaaaaaaaaaaaataaaaaaaaaaatataaataaaaaaaaaaaaattaaaatattaaaaataaaaaatattaataaaataaataaaatatttatttgtatatttttaataatattcacttatattattntatttaaaataattattacatttttttaaatcattattttttaaaaatctttgaatttccaaacataactccctttctaacatttccctttctctactattcttttatagtataaatcccctaacccttctcccacacacccattaattctccctaaattcctttacccatttaacaattatatttttttaaaaaatccn

SEQ ID NO: 733268 - DNA, 524 bp, Homo sapiens; identical to SEQ ID NO: 318604

SEQ ID NO: 733269 - DNA, 428 bp, Homo sapiens
ttcagcaacccgtctgaacagatctggcgtcctggagaattctagaatgaaggggaagagaggcagggaagagctgggaaatacgcaaagcgcctttttctccactttcggagatggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagca

SEQ ID NO: 733270 - DNA, 349 bp, Homo sapiens
agaagtgcgcctgggtgcgcacccaggcgcacttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagca

SEQ ID NO: 733271 - DNA, 1629 bp, Homo sapiens
tgggaaaaaggcctctgtcccggaagagtcatgggaggtgaaaggggcacgtttgaagatgcgagcgctatcttcacatagttctccagttgtatggagcctcttctgccaagagagggccatgcaattcatcccagaggaacctgaggcctgaaggaggtgagagaagacctctgtgaggaaagcacacagtcaccttctcggcaactaagcagtccctgagaccatttaacatgcaacccgaagttatggtcaatcccaaaagtcaccactccattcccaactaggacattaccaaagtgacctacccagagattgcttctcatccccagtcccaatgcacatccattcccaagaaatgctttgtcttcagcctctccaggcaccatctcccttcctgtgggagcagagagcttagcctggagcacctttccttcaagccagcaacacagagcactaggttcaattccctgaaggtggccactttaagagagaaatctgaaaaccccatttgctttcttttctcccatattggcatggatttctgtcttctctaacaccttgtgaccttctctatatcatgctttaaagtgtaataatatgattttttaaaagaaatttattacttgttgcaaaggtctttttaaaccagtttagatttcaagaaaaaataaatggaaatcatcgaaaattcatttcacattaatggtctaaaaataaaccaaaggacattatgtgtgcatgtgtgtataagtgcacacagaaatatatatacatatgtagactatatacatgtgtgtatatatgtgtatatatacatacacttgtataaatgtatatacacatatacctataatgtgtgtatgtgtatttattgaagaaacagataccatactcatttctaaaagaatattcagagaatatcaagatgattctggctgaaaaaggccagtggaaattcaggtgaaaatgttcatcaattcccattgcatcacctctgtaatttttcagctctctgtataaacattaaatgtcttatatagcagcaaaaatataaaatagttgtccatattttcacaggtgtggtgtaatttataaaattagaaagcaacttatcagctacttaagagaaatggcaagttttgatatgagtatacaatatataaaaatatatatagtgctatatatataaatatttggtctctatttcattttttgcatcagtattaatactaaaatatgtctcgctagtgatgtttttatgatatccctgatcctaactgaagagacagttatttatagtcatttattttaaaaaatgaaaataagtgaataataattaggttaacattgttgctccctgtgacaaaattttataagcaaatttcaaaagacatgttgtaaattaggaggctcaacaataaaacattatgctccagaaaaaaaaaaaaaacgcataccacccgggccccttgggctcacaggagcagctgattcgcgttgttggtaggctgggccctgggggcactcattaggcatcacaggttgcaagcaatccctgcttgctaacacaaggcccgttggcactttgggcctccaactttaagccaagggctcaacttgaacaaa

SEQ ID NO: 733272 - DNA, 4813 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733273 - DNA, 449 bp, Homo sapiens; identical to SEQ ID NO: 325045

SEQ ID NO: 733274 - DNA, 1209 bp, Homo sapiens
caaccagtcagtgatatcccatactttataacttgcaagcccctggccccttcccatctactaacttcaatgatcctgtgaggtaggtgcaatcattcctatttcacaggctcaccctccaagggtccaatgagaagccgccccagtccctcttccctctggcttctttcccccaggaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccaccccgtcgggtagagcgggaccgactga

SEQ ID NO: 733275 - DNA, 1318 bp, Homo sapiens
ggccagctctgctccctgcagtctgccctccggctgcgtgtggatgctgctcgtcctcgccctgtgggccctggtgccctgcctggcgttgttaaccctctactttttctcctccacaggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccaccccgtcgggtagagcgggaccgactga

SEQ ID NO: 733276 - DNA, 3193 bp, Homo sapiens
caaccagtcagtgatatcccatactttataacttgcaagcccctggccccttcccatctactaacttcaatgatcctgtgaggtaggtgcaatcattcctatttcacaggctcaccctccaagggtccaatgagaagccgccccagtccctcttccctctggcttctttcccccaggaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733277 - DNA, 3054 bp, Homo sapiens
caaccagtcagtgatatcccatactttataacttgcaagcccctggccccttcccatctactaacttcaatgatcctgtgaggtaggtgcaatcattcctatttcacaggctcaccctccaagggtccaatgagaagccgccccagtccctcttccctctggcttctttcccccaggaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733278 - DNA, 3302 bp, Homo sapiens
ggccagctctgctccctgcagtctgccctccggctgcgtgtggatgctgctcgtcctcgccctgtgggccctggtgccctgcctggcgttgttaaccctctactttttctcctccacaggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733279 - DNA, 3163 bp, Homo sapiens
ggccagctctgctccctgcagtctgccctccggctgcgtgtggatgctgctcgtcctcgccctgtgggccctggtgccctgcctggcgttgttaaccctctactttttctcctccacaggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733280 - DNA, 2290 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccaccccgtcgggtagagcgggaccgactga

SEQ ID NO: 733281 - DNA, 3732 bp, Homo sapiens; identical to SEQ ID NO: 325050

SEQ ID NO: 733282 - DNA, 1384 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaaccgtgagcaattccttctctctgtggtgcctgtt

SEQ ID NO: 733283 - DNA, 2323 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccaccccgtcgggtagagcgggaccgactga

SEQ ID NO: 733284 - DNA, 4846 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733285 - DNA, 3841 bp, Homo sapiens; identical to SEQ ID NO: 325049

SEQ ID NO: 733286 - DNA, 3702 bp, Homo sapiens
caaccagtcagtgatatcccatactttataacttgcaagcccctggccccttcccatctactaacttcaatgatcctgtgaggtaggtgcaatcattcctatttcacaggctcaccctccaagggtccaatgagaagccgccccagtccctcttccctctggcttctttcccccaggaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733287 - DNA, 3593 bp, Homo sapiens
caaccagtcagtgatatcccatactttataacttgcaagcccctggccccttcccatctactaacttcaatgatcctgtgaggtaggtgcaatcattcctatttcacaggctcaccctccaagggtccaatgagaagccgccccagtccctcttccctctggcttctttcccccaggaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733288 - DNA, 3563 bp, Homo sapiens
caaccagtcagtgatatcccatactttataacttgcaagcccctggccccttcccatctactaacttcaatgatcctgtgaggtaggtgcaatcattcctatttcacaggctcaccctccaagggtccaatgagaagccgccccagtccctcttccctctggcttctttcccccaggaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733289 - DNA, 4274 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733290 - DNA, 4783 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733291 - DNA, 4674 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733292 - DNA, 4644 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733293 - DNA, 4135 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733294 - DNA, 4307 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733295 - DNA, 4816 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733296 - DNA, 4707 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733297 - DNA, 4677 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733298 - DNA, 4168 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733299 - DNA, 1144 bp, Homo sapiens
gagggaagagtgggggaaacaagaagagcgatggtgtgaaggaatcctcagagagcaccaacaccaccatcgaggatgaagacaccaaagccccggtctcagcaccttatctggactgacttcctggagtgtcactatagcccatgaagtaggtgctgctgtgaacctcattctacagctgaggaaacagaggacagagaggccggtgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccaccccgtcgggtagagcgggaccgactga

SEQ ID NO: 733300 - DNA, 3667 bp, Homo sapiens
gagggaagagtgggggaaacaagaagagcgatggtgtgaaggaatcctcagagagcaccaacaccaccatcgaggatgaagacaccaaagccccggtctcagcaccttatctggactgacttcctggagtgtcactatagcccatgaagtaggtgctgctgtgaacctcattctacagctgaggaaacagaggacagagaggccggtgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733301 - DNA, 3128 bp, Homo sapiens
gagggaagagtgggggaaacaagaagagcgatggtgtgaaggaatcctcagagagcaccaacaccaccatcgaggatgaagacaccaaagccccggtctcagcaccttatctggactgacttcctggagtgtcactatagcccatgaagtaggtgctgctgtgaacctcattctacagctgaggaaacagaggacagagaggccggtgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733302 - DNA, 3637 bp, Homo sapiens
gagggaagagtgggggaaacaagaagagcgatggtgtgaaggaatcctcagagagcaccaacaccaccatcgaggatgaagacaccaaagccccggtctcagcaccttatctggactgacttcctggagtgtcactatagcccatgaagtaggtgctgctgtgaacctcattctacagctgaggaaacagaggacagagaggccggtgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733303 - DNA, 3528 bp, Homo sapiens
gagggaagagtgggggaaacaagaagagcgatggtgtgaaggaatcctcagagagcaccaacaccaccatcgaggatgaagacaccaaagccccggtctcagcaccttatctggactgacttcctggagtgtcactatagcccatgaagtaggtgctgctgtgaacctcattctacagctgaggaaacagaggacagagaggccggtgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733304 - DNA, 3498 bp, Homo sapiens
gagggaagagtgggggaaacaagaagagcgatggtgtgaaggaatcctcagagagcaccaacaccaccatcgaggatgaagacaccaaagccccggtctcagcaccttatctggactgacttcctggagtgtcactatagcccatgaagtaggtgctgctgtgaacctcattctacagctgaggaaacagaggacagagaggccggtgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733305 - DNA, 2989 bp, Homo sapiens
gagggaagagtgggggaaacaagaagagcgatggtgtgaaggaatcctcagagagcaccaacaccaccatcgaggatgaagacaccaaagccccggtctcagcaccttatctggactgacttcctggagtgtcactatagcccatgaagtaggtgctgctgtgaacctcattctacagctgaggaaacagaggacagagaggccggtgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733306 - DNA, 3811 bp, Homo sapiens
ggccagctctgctccctgcagtctgccctccggctgcgtgtggatgctgctcgtcctcgccctgtgggccctggtgccctgcctggcgttgttaaccctctactttttctcctccacaggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733307 - DNA, 3702 bp, Homo sapiens
ggccagctctgctccctgcagtctgccctccggctgcgtgtggatgctgctcgtcctcgccctgtgggccctggtgccctgcctggcgttgttaaccctctactttttctcctccacaggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733308 - DNA, 3672 bp, Homo sapiens
ggccagctctgctccctgcagtctgccctccggctgcgtgtggatgctgctcgtcctcgccctgtgggccctggtgccctgcctggcgttgttaaccctctactttttctcctccacaggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 733309 - DNA, 562 bp, Homo sapiens
gtggccattgacttcactgcctccaatggggacccgaggagcagccagtccctgcactgcctcagtccccgacagcccaaccactacctgcaggccctgcgtgcagtgggaggcatctgccaggactatgacagtgataagcggttcccagcttttggctttggggctcgaatcccccccaacttcgaggtgtcccatgactttgctatcaactttgacccggaaaatcctgaatgtgaaggtaaaaggggagattttcacctgccccgcctccccgcagacacactccacacaggagcacagactccactccccagggcccagcttcctgtcccttccacccatcccaggcctgtctttatcaggtgaggcttccagggccgaggcccagcatctgcacccaactctccctgccaagggaccatccaactctcccactgcttaatgaaggaactcgaggggagggcagtcctcagacctggaagcatttccttgctttaaggagtgtcaggagggggccctgctcatttctgccagcttcacaacttctcttcactcacag

SEQ ID NO: 733310 - DNA, 4623 bp, Homo sapiens
  misc_feature (2369)..(2369): n is a, c, g, or t
gccccataaatagcagcagagccggagctggagccggcgccagcggctggagcagcaagggagtcagggccagggccagagagccggagagaggagcccccgaccgagagcccaggtgagcccacccttcctccccagcccagccccagcccagcccagcttggcccagtctccataacaacatctcctggagcccgcagagagatcccagccctgcccaatcccttcaccaccacaagcccctgcctatctcggggacccccaagaactgggagacttgtggctggaaggcagagacccccctcccccagcccagaccctccctcacatatccagaaaggcacacactgtggggaggtagatacccagccagagaaaggtcccacttctgagggaggtacaggaactgtcacaccctcctggaaacggacacacgacatggggggacagacacggagggtggggcactcagacacaccaatgcacactcactcggggaagcatgacatgggatcagacagcctcaccctgagatctgtacagacacagatagatggactgaccggccatgaactctggccggcatacccctgcctgcttcagccgaggcttggtaccactgctgggggaaggtggcatgcgtgcatcccacgggcagcatggagggagccacgactccccaaaaatcctgtcgctaagagacggtgccagtgctgccaagaagtgtgaaaacaggggaggtggggagggatgtgaggcttgtcacagttagagctcctgccaggagcctgaaggagctttcagcagagccctggtcctgcctcccagcccaccaccactccttttccatcagctagccagaaggggaatgggggtagggagtggatagggatagccagcaggggactttccaacctgtctcctgcccactgcagactccacttctgagacccatcctcttcagaactccagaggcctctccaccccctgccccacccccttgccctagtttagctccctcgtgccaagactgagtgcagcgctggcacaacaccagtcgggaaatagcagaaggtgctgaggcggcagaaagtgtagatcaatcgatggcctaggagccaagactgccaggaacatccccaccccaatccttcagccctctccagccccatccacgcatacctaggccagcagcacagggcttctgagcaggagtgggaggctcaggtcctctgccctcccctgctcagaactctggtgaagctgaggaagcaggaggtccgtgaggccccagggtctagggaaggaggttaaggggtggggcccagggaccctagaggatagacccctctgctggcaggtgttccctttccagagtccaggccacctgctctgtccccacagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacggtaggcaagatcacctgtactcacccttggtccaggtattcaatgcccctgcatggacacctatggtgacatcatgcccaggaccacccccacctaagggaaaggggatggggtggcccttgtggtaaggttaggggagtcctgccacttgtatcccccttgcagatcgtggccgaggaggtatcaggcacaaacgactatgtgcaactcaccttcagagcctacaagctggacaacaaggttggaaccccagagtccaggcccccaactcccctgtcactcctaggcctcccactcaagacagatcccaggagcccaggcctgctctcttcccagtggagcccatcccccaccctccttgcagctctcaccaacctcaagggccctttctcctgtatcttcaggatctgttcagcaagtctgaccctttcatggaaatctataagaccaacgaggaccaaagtgatcagctggtctggagaactgaggttggtgcctggggctatggggatgaagggagggagagtaaagtaagaanacacagacaggagctgaccagccacctggtgcctctccaaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggaggtgccacaaataccccacccccagaatcccacccagatccctgggagaatcctgagggtgatgctgaagagaccaccataggtgataggaagtggagagggtggaaagcacctgggctcagctgaaggacggaaccatgggggtcttgctctgggaggctctgctggaagggagaaagaggggtcacctgatggacttgtgaccctgagcttgtggggtggggtctagatgcagtgggactgtatcaaccccaagtatcgggacaagaagaagaattacaagagctcagggacggtagtgctggcccagtgcacggtaaatttcacttcctgcttcaagccttgccccagcccctgcccctaccacactctcaggttcaacccttcccttgtttcaaagaccagtttctctgcttctgggaactggaaaccacccccaactgcaacccaaaaaactctggctcccccatgttccccacagaagccctacccaagctccctcctcaaaggaccaccccatcccctcgccttacccctctccctacctccaggtggagaaggtgcacaccttcctggattacatcatgggtggctgccagatcagcttcacggtggccattgacttcactgcctccaatggggacccgaggagcagccagtccctgcactgcctcagtccccgacagcccaaccactacctgcaggccctgcgtgcagtgggaggcatctgccaggactatgacaggtaggagagagtggggcgggagggaacaggcagggaggccttgcccaacggattccacagctttttcttctccccagtgataagcggttcccagcttttggctttggggctcgaatcccccccaacttcgaggtgtcccatgactttgctatcaactttgacccggaaaatcctgaatgtgaaggtaaaaggggagattttcacctgccccgcctccccgcagacacactccacacaggagcacagactccactccccagggcccagcttcctgtcccttccacccatcccaggcctgtctttatcaggtgaggcttccagggccgaggcccagcatctgcacccaactctccctgccaagggaccatccaactctcccactgcttaatgaaggaactcgaggggagggcagtcctcagacctggaagcatttccttgctttaaggagtgtcaggagggggccctgctcatttctgccagcttcacaacttctcttcactcacagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagcacctcagcctctaaaaaaaaaaac

SEQ ID NO: 733311 - DNA, 554 bp, Homo sapiens
gccccataaatagcagcagagccggagctggagccggcgccagcggctggagcagcaagggagtcagggccagggccagagagccggagagaggagcccccgaccgagagcccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcaggtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagcacctcagcctctaaaaaaaaaaac

SEQ ID NO: 733312 - DNA, 2809 bp, Homo sapiens
gccccataaatagcagcagagccggagctggagccggcgccagcggctggagcagcaagggagtcagggccagggccagagagccggagagaggagcccccgaccgagagcccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggagatgcagtgggactgtatcaaccccaagtatcgggacaagaagaagaattacaagagctcagggacggtagtgctggcccagtgcacggtaaatttcacttcctgcttcaagccttgccccagcccctgcccctaccacactctcaggttcaacccttcccttgtttcaaagaccagtttctctgcttctgggaactggaaaccacccccaactgcaacccaaaaaactctggctcccccatgttccccacagaagccctacccaagctccctcctcaaaggaccaccccatcccctcgccttacccctctccctacctccaggtggagaaggtgcacaccttcctggattacatcatgggtggctgccagatcagcttcacggtaaagactcagagggagggcacacaggcaagagggaggggctgagtccatagtgaaaggaaggagcccagaatctccactgccccaacttgggctgctcatgagccttcgcattgtcagcttatgcacccccacatcattatgtggctacctgtagcctccccaccactcatcttagtcctccctacagatcccagctctggcctaggcaatctggtggctctcatggttgcagcatgaccttcttcccacccccacccaggtggccattgacttcactgcctccaatggggacccgaggagcagccagtccctgcactgcctcagtccccgacagcccaaccactacctgcaggccctgcgtgcagtgggaggcatctgccaggactatgacaggtaggagagagtggggcgggagggaacaggcagggaggccttgcccaacggattccacagctttttcttctccccagtgataagcggttcccagcttttggctttggggctcgaatcccccccaacttcgaggtaggctagatgcgagggaaagaaggagatggggggcgtgtcagtcaggcagaaaaggcaggccctcactgctcccgccttgccctcacaggtgtcccatgactttgctatcaactttgacccggaaaatcctgaatgtgaaggtaaaaggggagattttcacctgccccgcctccccgcagacacactccacacaggagcacagactccactccccagggcccagcttcctgtcccttccacccatcccaggcctgtctttatcagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgtgagtcccccgggccccttccggctgaaggactcctcagcttctcatccccccaaatctgaccttcgtcttccaccatttgatgtcctgctaaggacgcgggagcccagctggccaccctgaagccccacttctccctcagatgaccctgcctcccctactcttcctctcacccctaaccacatcactgtccccaccctaggctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgagtcctggggcttccaaaggagtggacacagggggtgcaaagtggggcttggtagagcccaactaggctgggtgtagtgtagaagagagtgcttatgactctcccaccccctccgtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagcacctcagcctctaaaaaaaaaaac

SEQ ID NO: 733313 - DNA, 2186 bp, Homo sapiens
tcctgtgtctccttataaaatggtggctagggaactggacatcattctcaaagctatgacgttcagcaaggtatgtgatggcttttaaggagcacgggaagatcacatcctgctgtattccgggttagtttgagccccataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggagatgcagtgggactgtatcaaccccaagtatcgggacaagaagaagaattacaagagctcagggacggtagtgctggcccagtgcacggtggagaaggtgcacaccttcctggattacatcatgggtggctgccagatcagcttcacggtggccattgacttcactgcctccaatggggacccgaggagcagccagtccctgcactgcctcagtccccgacagcccaaccactacctgcaggccctgcgtgcagtgggaggcatctgccaggactatgacagtgataagcggttcccagcttttggctttggggctcgaatcccccccaacttcgaggtgtcccatgactttgctatcaactttgacccggaaaatcctgaatgtgaagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagcacctcagcctctaaaaaaaaaaac

SEQ ID NO: 733314 - DNA, 473 bp, Homo sapiens
  misc_feature (86)..(86): n is a, c, g, or t
  misc_feature (107)..(107): n is a, c, g, or t
atctttgcatccctgggacgatttccagttgagcatggtgaataatctttttgataggctgttggatttgagttgctagtattttnttggggcattttgcatctgtnttcatcagggatagtggccttcagctttcttttcgtgtgtgtgtgtccctgtcttgttctggtattggggtaatattggccttgtagaatgaatttagaagaattcctttccttttgatttttttggaataatttaagaagaattagtattagttcttctttaaatgtttggtagaattcatcagtgaagccatgtggtcctggacttttctttgctaggagagtttttattactgattcaatcttgttactcattattggtctgtttgagttttccatttcttcatgatacagtcttggcaagttgtatgtgttgagtaatttatcaatttccattaggttttccaatttgttggagtatgattg

SEQ ID NO: 733315 - DNA, 4006 bp, Homo sapiens
  misc_feature (361)..(361): n is a, c, g, or t
gtcttctagacccagctcctcggcgctcatctccagctgctttaagacaaggggtgggggaaggggagggaggcaagaaaagatgagggtgggggaggggaaaagagggaatgcaaggggaaggagggaggagacggggagaaggaaagattggaagaaaaggatctccgaggaaggggctgagagaagggcagggtgaactggactaaaggccagagtaggaaggagaagaggggccaaaaaagaaggggatgaaattaagcacagaagatgggtaaagaaaaaagtatcagggaaagggcaaaataagagaaagccttgaggataagagggtagaaggctaaagaacaaggggaccacngggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggcgctgaatcaccgttcagccgcccccctcccctcctccccgaccggtgcccgcagtccccgcctcctcggccgccgcctccacggggcggggccctggcccgggaccagcgccgcggctataaatgggctgcggcgaggccggcagaacgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaaaccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacatagtcaa

SEQ ID NO: 733316 - DNA, 3685 bp, Homo sapiens
  misc_feature (361)..(361): n is a, c, g, or t
gtcttctagacccagctcctcggcgctcatctccagctgctttaagacaaggggtgggggaaggggagggaggcaagaaaagatgagggtgggggaggggaaaagagggaatgcaaggggaaggagggaggagacggggagaaggaaagattggaagaaaaggatctccgaggaaggggctgagagaagggcagggtgaactggactaaaggccagagtaggaaggagaagaggggccaaaaaagaaggggatgaaattaagcacagaagatgggtaaagaaaaaagtatcagggaaagggcaaaataagagaaagccttgaggataagagggtagaaggctaaagaacaaggggaccacngggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggcgctgaatcaccgttcagccgcccccctcccctcctccccgaccggtgcccgcagtccccgcctcctcggccgccgcctccacggggcggggccctggcccgggaccagcgccgcggctataaatgggctgcggcgaggccggcagaacgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaaaccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacctcgttgacatgcacagtttgcaatcttatgttgatcgatgttaaacgtcacagcagtacttgctcaataaaggtcatattggaaacatagtcaa

SEQ ID NO: 733317 - DNA, 3760 bp, Homo sapiens
  misc_feature (361)..(361): n is a, c, g, or t
gtcttctagacccagctcctcggcgctcatctccagctgctttaagacaaggggtgggggaaggggagggaggcaagaaaagatgagggtgggggaggggaaaagagggaatgcaaggggaaggagggaggagacggggagaaggaaagattggaagaaaaggatctccgaggaaggggctgagagaagggcagggtgaactggactaaaggccagagtaggaaggagaagaggggccaaaaaagaaggggatgaaattaagcacagaagatgggtaaagaaaaaagtatcagggaaagggcaaaataagagaaagccttgaggataagagggtagaaggctaaagaacaaggggaccacngggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggcgctgaatcaccgttcagccgcccccctcccctcctccccgaccggtgcccgcagtccccgcctcctcggccgccgcctccacggggcggggccctggcccgggaccagcgccgcggctataaatgggctgcggcgaggccggcagaacgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaaaccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacatagtcaa

SEQ ID NO: 733318 - DNA, 669 bp, Homo sapiens
ccaacgtccgtcacggtgccgagcagtgccagccgctctaccatggccgacggcctgattcccaagggctgcgtcccggggccgtgctagtgcagtgaatgttcaggaaacagaccaggtggcaggagggagtcttgtcctcaaggaacctcataagtcttgctagggggacaaacaacgagagaatgaaactggcagccatagaatccgggccttgatgcccaggcctcgccatgcatacctgctggccggcatctccctgagacccgtctggcacaggcaacggcagggcccggcccttggagcacagggatggcagagcagggtcatcgaagcaggtggcgtgcagacagtggcttctccgcaagagctcctggctctcagggagctgagggctcctcaatggggaattctggctgagctccaggggaaagcgggttggaggcctggctcctccgcccccatctcctctgccccaaccctggaagggggtcagatatcaatgctaacatttgtgctgactcaattaattcaaacgattcacaaaaacaaacttgcttaaagtattaatttcctaaaaagaactaaaatgagttcaaataattcacataattaaattattttaattgttaatttaattaaaacatctcagttttcaaagcaaaaaaa

SEQ ID NO: 733319 - DNA, 898 bp, Homo sapiens
  misc_feature (6)..(6): n is a, c, g, or t
attacnaacatgcgcctggccaggtctcagtcttttagcaaccctggatctctggactgtaaacttcacttggactttgtagttcctccattcctcccttaagtgggacaggatgagtcaagtgggctgatgttggctatttctcttcctccaggtgaaaggcaggagctggagttgggtatctcccttctggtcagttaggctctgataaaacccctgcaggtttagctcacgttaaatagttcaccgcgctcagccctagtttaatggtttttagtatattcccagagttatgctattttaggacatttttataaccttacaaagagtccctgcccattagcagtagctcctcattccctacttttccagctactgacaatcactaatgtactttctaaggatttgcctattgtgggcatttcatttttatttttaattgattgattgattgatggatggatggagtctcgctgtgtggcccaggcttggagtgcagtgtcatgagctcagctcactgcagcctctgtctccttgttcaagcgattctcctgcctcatcctcccgagtagctgggattacaggtgggcaccaccacgcctggctaatttttgtatttttagtagagacagggtttcactatgttggccaggctggtctcaaactcctgacctcacgtaattcactcgcctcggccttccagattgctgggattacaggcgtgagtcactatgcccggccaattctaggcatttcatgtaatgtaatcatatgttctatggccatatgtgtctggcttcttagcataatgttttcaaggttcatcatctatgtatcagtacttcatttctttttgttttaacagactttattttatagagcagttttaggtttacag

SEQ ID NO: 733320 - DNA, 532 bp, Homo sapiens
  misc_feature (16)..(16): n is a, c, g, or t
ggaacatggttctganacttggggatataccctaggcttaaggactggaaagccccctgaagtcccgagaccacaaccctccaccttctaaagataagacaagtcactgaaggtaaaatcagctcctcagtgtctccaaggacaggaatgccatgggctgggaggcgccatgggtgaacagacttccctacttcctgcctccccaagggtggggagcagtctaggggatggctgtactcctgggcccagtgtctaagtgaaaattaggaggaaatggagggagggtggcgagcgaggacagactggccaaggtcccccgcagccactcctgaagtcctcacgagggagaagcagcctctccttccagccttccccaagtcctccctaagagtgtattctactggtttctgtgcagatttttttcggctgcgaccaatagtagcttaaacatggattattttctttttaatttcttcctgcaaaattcttaggaaaccattaataaaagtaatatacatgtgaaataataaaa

SEQ ID NO: 733321 - DNA, 653 bp, Homo sapiens
ctactgccctgtgtgcagggccaggaatctgggccactccggataggcatcggcttcggcctccgcctgcctcagggccaggccagggccttgcatctgctgcccgagaaaaggccgaaggaagcagggcctcagggcaaggctactcaggcctgtgggcatcaattgccagcatctcagcctccagcagctcaggcccgggccgacccagtcccaggcacaccctcccagaccaggagcttcaggtctgcaggccttcaatcaccaaactccccacgatgtttctccgggcctccacctcgggcaccaaaacaggtcactacctccctgaagcccaggccttgccctggcccaaagaggccagtttctctggagctcattctccaaaagtcatcagtctagttccagagccacggaggccccctggaacaccccctccaaacccaaccctcccaaccaggccccagatctcggggagtccccgagacaccctgaagggctggctggccggaggtcaggtgtgttctcctgctctgaaccctgggagccccttgtggagtctgctgtctccaggctgaagaggaccaagggcaccaaggccccattcagccctccgtgtatctaataaagtctgaccctgtgaaaaaaatgtt

SEQ ID NO: 733322 - DNA, 1154 bp, Homo sapiens
ttaaaaaaaaatccaaaacaatattgttagaacagtgcaacaaatatttacaagtcaatagtcttttctttgtagaatattacatttatggtttcaataaatgatttagcagttaaagctgagatgaagtgtggttctcatattcaatcttgaaaaactaaaccatctttaaaaagtagaacgtccatgtgaactcatgcctgaagccatgtttgaacgctagataaaattgccctgggacagaactgtagttcacctttatgaaatcaattttaaacttgttattgtgagccacaataaatacagttcacattgcaaactatcacacactcatacaaatgttactaaaaaaaacttaccaagttatatcctctctacatgcaatgcattctggtattttctctttcatttgctttttttaaaaagatctcacaatccactaatgagtcacaacctgtggtttgtaaagtagtgttagaatgaacccattggccacatcagaaatatctaaggattttctttccaacctaaaatcttttccttctctgttaattaagagatcttaacaaatgggaaattctgagtaagttcctgaatttttctttcatttgatcatggccttctagtgtttactaaagtggtttttcttttcactgccatccttgggtatttttgtatgctgggttgtattacgggtgaagggttgatggggttgtaggcctgagaggatcatttttattacagactctatccttgactataatatgatagcgttacatggagtttagtgactcatgagctcatgtctgactcgtaaggggtcctttgttaattcagatgacattggtcttatccgttatcaagaatccatgagtttggctgggtgcggtggttcatgcctgtaatcctagcactttgggaggccgaggcgggtggatcacaaagtcaggagttcaagaccagcctgaccaacatggtgaaaccccgtctctactaaaaatacaaaaattagccgggagtggtggcacgcacctataatcccggctactcaggaggttgaggcaggagattcgcttgaacccgggaagcagaggttgcagtgagccgagattcgcactgggcgccagcctgggcaacagaggcgactccgtctc

SEQ ID NO: 733323 - DNA, 520 bp, Homo sapiens
aattttttgtatttttagtagagacggggtttcaccatgttggccaggctggtctcgaactcctgacctcatgatccacccgcctctgcctcccaaagcactgagactacaggagtgagccactgtgcccagcctactctggttttagtgcattcaagaggaacaaaaaaggaagaaaatcactagtaaatatacctctttctggttagagtggatgtttggaaattatatatatattatataatatatattatatatatacacaaacacgtacatacatgcacacacatatatgcctttttgattataggatagtataccaaaactcagaaatattatggaattaacagaatttagtaaggcagataagtagtaggtagaaaaatattaattttatcttccagcagaagcactgtgaaaaattagacaacaagaaaacattccattcaaaataatgacaataaggccgggcatggtggctcacacctgtaatcccagcactttgggaggctgaggcagg

SEQ ID NO: 733324 - DNA, 792 bp, Homo sapiens; identical to SEQ ID NO: 577630
  misc_feature (186)..(187): n is a, c, g, or t
  misc_feature (193)..(193): n is a, c, g, or t
  misc_feature (197)..(197): n is a, c, g, or t
  misc_feature (199)..(199): n is a, c, g, or t
  misc_feature (205)..(205): n is a, c, g, or t
  misc_feature (207)..(207): n is a, c, g, or t
  misc_feature (224)..(224): n is a, c, g, or t
  misc_feature (240)..(241): n is a, c, g, or t
  misc_feature (244)..(245): n is a, c, g, or t
  misc_feature (250)..(251): n is a, c, g, or t
  misc_feature (277)..(277): n is a, c, g, or t

SEQ ID NO: 733325 - DNA, 817 bp, Homo sapiens; identical to SEQ ID NO: 314388

SEQ ID NO: 733326 - DNA, 491 bp, Homo sapiens
catatctaggtgccttctcccaactcagatcctttgactatagaaagacacagatttcaaggctgagatccacaaaactctagcaaatactgcacagacactgaccaatgacagcaggtgctgcctgtcaccctggagcaccaggcagggttccaaagcacccttgctgtgccagcctctgattgctggttatagggaggtctggggtagtcccaaaagctgggatgtctaaggcagctggggtcagtcaggaggctcagggcagtggcaggaaaatattttcctccctggtagagccacagcggggtatccaggctgaatattattggcgagaaggaccatggcaccgcaccaagacctgcaggacaaactttgttggagctgaatccagaaaaacaatcttcttctaaaccactctcctgcccctcatttaattattgtgcttttgggtgcacttggactactctgaaacattcagaactctgtcaaaa

SEQ ID NO: 733327 - DNA, 1032 bp, Homo sapiens
cttggacgtcagcactgaaggctacaacaactgggtcttcatgtccacccacttctgggatgagaacccacagggcgtgtggaccctgggcctagagaacaagggctactatttcaacacggggacgttgtaccgctacacgctgctgctctatgggacggccgaggacatgacagcgcggcctacaggcccccaggtgaccagcagcgcgtgtgtgcagcgggacacagaggggctgtgccaggcgtgtgacggccccgcctacatcctgggacagctctgcctggcctactgccccccgcggttcttcaaccacacaaggctggtgaccgctgggcctgggcacacggcggcgcccgcgctgagggtctgctccagctgccatgcctcctgctacacctgccgcggcggctccccgagggactgcacctcctgtcccccatcctccacgctggaccagcagcagggctcctgcatgggacccaccacccccgacagccgcccccggcttagagctgccgcctgtccccaccaccgctgcccagcctcggccatggtgctgagcctcctggccgtgaccctcggaggccccgtcctctgcggcatgtccatggacctcccactatacgcctggctctcccgtgccagggccacccccaccaaaccccaggtctggctgccagctggaacctgaagttgtcagctcagaaagcgaccttgcccccgcctgggtccctgacaggcactgctgccatgctgcctccccaggctggccccagaggagcgagcaccagcacccgacgcctggcctgccagggatgggccccgtggaaccccgaagcctggcgggagagagagagagagaagtctcctctgcattttgggtttgggcgggagtgggctggggggagaggctggagcaccccaaaagccaggggaaagtggagggagagaaacgtgacactgtccgcctcgggcaccgcgtccaacctcagagtttgcaaataaaggttgcttagaaggtgaaaaaaa

SEQ ID NO: 733328 - DNA, 416 bp, Homo sapiens
  misc_feature (281)..(281): n is a, c, g, or t
  misc_feature (283)..(283): n is a, c, g, or t
  misc_feature (296)..(296): n is a, c, g, or t
  misc_feature (298)..(298): n is a, c, g, or t
cagaaggttggggccatccaaccaggcagtccgcctgcacagcagctgtccctgctcatcgggctggaggacagaagacagaaccctaaaaccacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagccatcggctgtgactcaaggacttntnttaaaggaccggnantggcataagctgtttcactgctcgagtcagaactactggtggacagcctttgctgcaaggaggacagctgctcttacagctctttcacgggtcctatccaggtccagggttcaagggg

SEQ ID NO: 733329 - DNA, 238 bp, Homo sapiens
aaccaggcagtccgcctgcacagcagctgtccctgctcatcgggctggaggacagaagacagaaccctaaaaccacaggtaagggccactggttcccctgtgcccttctctcacccttgccatccttcccagcctgtctctgcagcagctctgtaggcatcttgttgcatgcagagggagtgtccagccctgggaggaagctctcaggcactgggagctcgctgaccccagcagagat

SEQ ID NO: 733330 - DNA, 1737 bp, Homo sapiens; identical to SEQ ID NO: 1507

SEQ ID NO: 733331 - DNA, 1314 bp, Homo sapiens
  misc_feature (431)..(431): n is a, c, g, or t
  misc_feature (701)..(701): n is a, c, g, or t
atgagtcagcaaaacaccagtggggactgcctgtttgacggtgtcaacgagctgatgaaaaccctacagtttgcagtccacatccccaccttcgtcctgggcctgctcctcaacctgctggccatccatggcttcagcaccttccttaagaacaggtggcccgattatgctgccacctccatctacatgatcaacctggcagtctttgacctgctgctggtgctctccctcccattcaagatggtcctgtcccaggtacagtcccccttcccgtccctgtgcaccctggtggagtgcctttacttcgtcagcatgtacggaagcgtcttcaccatctgcttcatcagcatggaccggttcttggccatccgttacccgctactggtgagccactccggtcccccaggaagatctttgggatctgctgcacnatctgggtcctggtgtggaccggaagcatccctatctacagtttccatgggaaagtggaaaaatacatgtgcttccacaacatgtctgatgatacctggagcgccaaggtcttcttcccgctggaggtgtttggcttcctccttcccatgggcatcatgggcttctgctgctccaggagcatccacatcctgctgggccgccgagaccacacccaggactgggtgcagcagaaagcctgcatctacagcatcgcagccagcctggctgtnttcgtggtctccttcctcccagtccacctggggttcttcctgcagttcctggtgagaaacagctttatcgtagagtgcagagccaagcagagcatcagcttcttcttgcaattgtccatgtgtttctccaatgtcaactgctgcctggatgttttctgctactactttgtcatcaaagaattccgcatgaacatcagggcccaccggccttccagggtccagctggtcctgcaggacaccacgatctcccggggctaacggaaggacatcctgttcaggggaagaaagccctggccctgaattctggtaacggatatcgcgttccagggttttgatgtggtgggatgatccgcaccatcttcactgatgtgcttccctttgatgcccattgagtgccagctttgctcattataccccaaagaccttttttccactgcccagacagcttataccacccagtgttcagggatctctgaagaacccacagaccaggtgaattactgatttctaagtccaaaaactatagagcagaagaattgagaaagagaatgagaccatgtcaacaaggctgtttccaactctccccattttcctgttctactgggaggttctg

SEQ ID NO: 733332 - DNA, 791 bp, Homo sapiens
  misc_feature (20)..(20): n is a, c, g, or t
ctggggccgactgtctgtanctagtcagttttcaaaaatccccatttcttgttctttctcttttcacagtatgtttgaatcaagccatattcatacattgaatttgtttgacagagtctctgaatctgttaagtttgaaggctagctctcacattctctatcaccagctttatctctgtcttcctttcccacccttcttatttgtaatttgtttgttaaagagatcaggttgtcaggtaaaattagtcttccacaatctggattttgatgattatgtcaccatggtattgtttaacatctttctctttcccccaaaccattggttttcagtcatgagagatagatataagcattaaaactctatagctgaaatggccttgaagatcctttgtaacccatagcttttaaaagctggtacaagtcaattggccaaaggatattgagttaggcagggccagcctttggcaatgcaattgctgcttcctcagactcaacaaaaattatttgttttctttgaaaatgggaaaaagctacaggataagtcataaggcataagcataactagaattgtctgcaaaataagcttatacacatggtaaaggcctcatgattctaagcctgtgtcccaggttccctttcaagttaccaagatttgcagagttacttcattattatgaagatggtgagtgcatgcagaacaaatgtattcctggtaaaagaacattaacatgatggggaatgcagctattctagatgtgatatataagagtagggaaactaagtttttttta

SEQ ID NO: 733333 - DNA, 465 bp, Homo sapiens
atataatcataatacccattatcacttgttaaaacataaataataatcctttaataatgccattagtcagttttcaaaaatccccatttcttgttctttctcttttcacagtatgtttgaatcaagccatattcatacattgaatttgtttgacagagtctctgaatctgttaagtttgaaggctagctctcacattctctatcaccagctttatctctgtcttcctttcccacccttcttatttgtaatttgtttgttaaagagatcaggttgtcaggtaaaattagtcttccacaatctggattttgatgattatgtcaccatggtattgtttaacatctttctctttcccccaaaccattggttttcagtcatgagagatagatataagcattaaaactctatagctgaaatggccttgaagatcctttgtaacccatagcttttaaaagctggtacaagtc

SEQ ID NO: 733334 - DNA, 1283 bp, Homo sapiens
tgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggcccctggcagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttggggggggtatttaagttacatatattttaacaacctttaatttgctgttgcaataaataccgtatccttttattatatctttatatgtatagaagtactctgttaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctctta

SEQ ID NO: 733335 - DNA, 514 bp, Homo sapiens; identical to SEQ ID NO: 4130

SEQ ID NO: 733336 - DNA, 1225 bp, Homo sapiens
tttttttttttgagacggattcgctctgtcgcccaggccggactgcggactgcagtggcgcaatctcggctcactgcaagctccgcttcccgggttcacgccattctcctgcctcagcctcccgagtagctgggactacaggcgcccgcaccgcgcccggctaattttttgtatttttagtagagacggggtttcaccttgttagccaggatggtctcgatctcctgacctcatgatccacccgcctcggcctcccaaagtgctgggattacaggcgtgacaccgcgcccggcctcctccactgatttttaaaaatccagtcaacagtaggattttcttgttgaactgtgaaggcctgtgctcggtagggactttgtgaatcatccctgtttgggtcccagagccactggagggcccatcactggagtggctggtgagacactccagggcatgagagttgctatgggcctctgtgtggcttctagaggcttcccaggggcacaaagactatgtgacccaggtggaagctcgggaggctcacgctggacacatgctgcacactctggctcccctgtggctgcagctgcacccacctacccagcattctccccacgacctgtccagcccaagcccacggcactcccaggggagcccaggacaccctcaactttttagtggattactagagtatcagaccacccatttatctctcagttcctcactcccacccctgcacccagcaagtcaccaagtcccccaggtgagtaaactggagctaacagcagttggtacttacggcatatactggatttggctcactcacacgtggtattcctatcttcatctactgtatcttcctggactacataagctgcaaagttaaaaactgcatttctcagattcccttgagctaggttccagacgtgatttattatcagtcaatcaaacacattcgcatgagttttgtatagggaacaatgttaagtcggaagaaaggcagaatgcaagacacggttctggagccagcagctttattggtagcatcctgactcaataggcagctttcctgataatagcaggaacatcagcctccttggtggcccactcattgtgtggctctggaaatcattcctggatattccacctagtctgtttctttagctttcccaacaactctgtgagccatgtaacattctgtaataaatttctttctgcttaaattagt

SEQ ID NO: 733337 - DNA, 903 bp, Homo sapiens
gcaccagaagaagggacaagcagttctgtatgaaggtggaaaaggctatggaaaaagccagctgttggctgaaataaactttctggcacagaaagaagggcatagctacccttcacaggtgctttggaaacccactttattgtgaggtcctatgccaggaccttctctctaaggacgtgttgctctttcatgtcctacaaaaggaggaagaggaaaacagcaagtgggaaaccctctcagccaatgccatgaaatccataatgtatagtatttctcctgccaactctgaggaagcccaggaactttatgtctgcacagtcaaggatgatgtgaacttggatacagtacttctcctaccctttttgaaagaaatagcagtaagccaactggatcaactgagcccagaggaacagttgctggtcaagtgtgctgcaatcattggtcactccttccatatagatttgctgcagcacctcctgcctggctgggataaaaataagctacttcaggtcttgagagctcttgtggatatacatgtgctctgctggtctgacaagagccaagagcttcctgctgagcccatattaatgccttcctctatcgacatcattgatggaaccaaagagaagaagacaaagttagatggtaggtatgatgaaaggaggtaggtatgatgaaggacgcgtccttcatcatacctaccaatgaatatcttcctattcccagtctaagagtttttccattatattctacaaatccatcatttccctaaagaaacaaacgaaaaaaatccttgcttttggctatagttcataaatgatttaatagatcatcatttcttcattgtaaatgtagtgttttaaccatacaatgtaggtgggtatgggtaggtatgatgaaaga

SEQ ID NO: 733338 - DNA, 991 bp, Homo sapiens
ttctatttcctatattcatcataaacttcatgcttgatgttgaaattgttttctgaaaatagagaatacaaagaggagattttaaaatgtcagtggcagccccacactcctttttaatcttatttcctgatatcttgagtttacttggacgtagagttttccttgactatggttatttctggtagtagcagctccagattaggcaatggttttcttcagagatagcttagagtgagccccagaacaaggtcaatgcgaagattgcttgtgtctgcgtgtccagggcacagtgatcctcatcactagccggggggctccgtgaggatctgctcctggtcgtttctgttctgtatcttctctgcagcccttactgaagccgttaccaactggcacaattcaattcctactgtacccatcatgcacagatggctgaagtattgagaacgctccagtgaccgggaggcaatagtctgtctctctgtctttctcatacacacttacacacacatacacacaaccttgttgcttaattttcagagagtctactttcagaaaagccttcaggaatacatcatgtacaaaactgagaaattacctgaagtatctttaaatttagtaaaaagttgcattgttttttgaacatcacacttgaaaagtacatgaatacaaacatacttaggaaaaaaagctttaattaatttaaaaaggagaacaatgctatatgctgtatcccacctttctctgaatgttacattttctcccctatcccaggctgcatctaagaaaactcaaagggaatatgctatctatcttttccgagcaatgaaagctctgggttttttccttgcttttcagggcacaatacttctctttcttcctggttagacaggataagttctgagtcccctggtatcatcagcttacttcttctctgttaaatattcacaaaaaatcactaactttcatgcctcagcaaacctccactgcctaa

SEQ ID NO: 733339 - DNA, 972 bp, Homo sapiens; identical to SEQ ID NO: 12579

SEQ ID NO: 733340 - DNA, 776 bp, Homo sapiens; identical to SEQ ID NO: 11952

SEQ ID NO: 733341 - DNA, 1189 bp, Homo sapiens
tggtatagctttctctatccttttgcttttaatgtattttcttgtggataacacacgattgggctttgtttgtttttgaaatccattctgacaatctcttttttaattggtgtaatcagattattcacatttaaagtggttattgatacagttggattaatatctacaatgtctgtaactgttttgtatgtgtctcacttgactttcatatctaattttgaatttgtaatttcatattctttgccttaaagagaacgcttgcagatccctcaaaacctggagacaccccccaccttgcacacattataccggtatgtgatggtagaaaagctgcacatcagtcttggcaggcagggcaggagggatgcagggattcacagatgcgactgtgcaacgcacagatgcactgggtctttgcttggtgggttcgaagcctccagacgctgacaaacactgcagccaatgagtgggttcctatggtccgatatggagggcaaggggcgggactccctcctgcctctccctggctgggttcagagcctccgcggagagactgcgttgggcccagagtgggcgtggcttacgtgtccgccggctttcctggcaggcctggcgggggggccaggttgccatgacgaccgcggctaggtcgcggcagactcggttggtgactccgggcgcgtcgaagatcttgtacctgtcgttcgcagtggctcactttcccaagccatgggcagcaggaagaaggaaattgccctgcaggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattagcagaggcagatcgtcttgatgtcctcgaaaagtacagagggaagtgcgagccaacctttctgttttatgcaggaggagaactggtggctgtggttagaggagcaaatgccccactgctgcagaaaaccatcctagaccagctggaggccgaaaagaaagtgctggctgaaggcagagaacggaaagtgattaaagatgaggctctttctgatgaagatgaatgtgtttcccatggaaagaataatggtgaagatgaggacatgg

SEQ ID NO: 733342 - DNA, 439 bp, Homo sapiens
gtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattagtaagattctctctcagccaacagtcatacaacattgtaaaaagaatttaaaaatttaaaagagtcaggaaggagaagtgtgagagtgacctttctcaggtcattaaaaaggaatcagtgtggactttttgttgatactgtcatgatactttctaatttctctagttatgaaggttcctattccccaccccacctccctgtgtccctcttggcttgagcagttcttggtgctgtatgaagagaagaaatatatgtcactcaaatgcatattctccct

SEQ ID NO: 733343 - DNA, 2542 bp, Homo sapiens
atatgtaggctcatttgtgggagattgcaaactttatgtgcccccagttctccttggttttgtaggaaagctaaaagaaaaccttgtactctcactaataatgaaattcatagccaatttagaaagggaaaataacctgaaaaccaaaatacctcattcatctgaagatgcctggaataaaatatggaattcttctgtacctacctcccccttacagacttttctcctattttgagagagaaattcaagaagaagaatacagcttgttctctttccacaaatgatactttgtctaagggaataggagataccaagaaacagtatctttaaaaaagtaagctgcccacaggccttcttggagaatgaagaatatcagccccattcagggtttaccaatgtctctctgaggtgacaatacattctggttttccaggacagtcctggcttaggtctgctgtccttctataaatattaacaatgatccctcttatttccaaacgtgtcccagtttagacaacaaattatacagtgtctgcccccaacacacacacacacaccccaccatctttatgggttgttgttgttttcttgttgtttttaattttgtagaattggctttgtcttctccaaagcagataacagcttaaactaaagagcctagctacttctttctgactgagcagggtcatagtaaacagagaagaatggatcacttcctcctctgaaatctccatcaatccactttctgtccaactatctctctacccagcctatttttggtcctagttttcctctcataacccctgggctgtgagtcctgagttctgccttcatatggcagagcaagctagtcattattatgccaggttaggtggtggggcaagacaaaagatagctcttggggacacttgcttggtctgtagagatccacagggcactagtagggtattagagcatttattggtttctttcttccttgagttgagttacttctatcccaaaacagacaggtcttacgttaaccttcaccttaaaaaggatattgccttttttccttctgcttcacaaatttgctccaacactaattcccttgcatttgatttcatcattatgattgttcatcaaccattcttcacgaaaaatcctcacatcatgtcatataaaggttttattatttttaatggaaaataacattgagagattattttcctttttcataaaatttccctttttccctccctctattctctttactaacattggaaattaaacaagttttacaggctctattgttattaaccctcaaatctattcttcagagaatatatgatcagcctgtgtttactatgcacctactcttataccagaaactgtgaatacaaatacatatatttcctacttctctctttaattggggcacacagtcccatggtccattctgcatttttcaaaattgaatataattgcaacacctgataggttttgccacttagaattctgaaaataaatcaactctgttctaaaccttaagtttccactattattgccaaactctggactgatacaataagccttttaaaaggtgaatttaacacttcacctattatggttatttaagtaaaatgagttttcaaatatttcccccaggagaaatataaaggactatgcaaaaatagaaggagaaaaaggttagttagaggtccagaaggagaattaaaacatggaattgataaattcacctactgatttatgatgttaatgagcaggtacctatacattttatttacttgaaaacattttggccattaactatttctgttttctaaatacatttgtgtttataaaattttaaaatctatatcacaagccttagacatgcctttctttgcaataaagtatatatacctttttacaaatgtaaattttattttgaaacttggcattttctttataattcctaagatatctttgggcacacagactacagataaatctatttaaatcaattcatcattatcactggtttaaatatttaatgtaaccattggaatttttattcttattccttcagagaatcctccttttcttctatgtttctgactgcaatacagcccgatattgttattccctatatcttaatgaaaagcaagctgtcagcaaaatgcatttatagtttccagatgtttaacaatctctttcttcttttcttttttgttattatttttatttatgtgaagttagttagctgaggtaccaaaaaagagacaaagacagtattaaaaagtgtgcataaagcacttatttttgtactttagtacaatgttttatagaactttgtgatctatctaaatatattaagtaaaattacaccattcacttgttgggaaaataatctttggtttggaagatattaacataatgggcatcttagaatcataaatcacatgaaatgagagacaatgcaatattgtataattcctggatgatgcaattgttttaattgaattttcaagtgccattataaagttttaaaaattatcaa

SEQ ID NO: 733344 - DNA, 2487 bp, Homo sapiens
atatgtaggctcatttgtgggagattgcaaactttatgtgcccccagttctccttggttttgtaggaaagctaaaagaaaaccttgtactctcactaataatgaaattcatagccaatttagaaagggaaaataacctgaaaaccaaaatacctcattcatctgaagatgcctggaataaaatatggaattcttctgtacctacctcccccttacagacttttctcctattttgagagagaaattcaagaagaagaatacagcttgttctctttccacaaatgatactttgtctaagggaataggagataccaagaaacagtatctttaaaaaagtaagctgcccacaggccttcttggagaatgaagaatatcagccccattcagggtttaccaatgtctctctgaggtgacaatacattctggttttccaggacagtcctggcttaggtctgctgtccttctataaatattaacaatgatccctcttatttccaaacgtgtcccagtttagacaacaaattatacagtgtctgcccccaacacacacacacacaccccaccatctttatgggttgttgttgttttcttgttgtttttaattttgtagaattggctttgtcttctccaaagcagataacagcttaaactaaagagcctagctacttctttctgactgagcagggtcatagtaaacagagaagaatggatcacttcctcctctgaaatctccatcaatccactttctgtccaactatctctctacccagcctatttttggtcctagttttcctctcataacccctgggctgtgagtcctgagttctgccttcatatggcagagcaagctagtcattattatgccaggttaggtggtggggcaagacaaaagatagctcttggggacacttgcttggtctgtagagatccacagggcactagtagggtattagagcatttattggtttctttcttccttgagttgagttacttctatccccttctgcttcacaaatttgctccaacactaattcccttgcatttgatttcatcattatgattgttcatcaaccattcttcacgaaaaatcctcacatcatgtcatataaaggttttattatttttaatggaaaataacattgagagattattttcctttttcataaaatttccctttttccctccctctattctctttactaacattggaaattaaacaagttttacaggctctattgttattaaccctcaaatctattcttcagagaatatatgatcagcctgtgtttactatgcacctactcttataccagaaactgtgaatacaaatacatatatttcctacttctctctttaattggggcacacagtcccatggtccattctgcatttttcaaaattgaatataattgcaacacctgataggttttgccacttagaattctgaaaataaatcaactctgttctaaaccttaagtttccactattattgccaaactctggactgatacaataagccttttaaaaggtgaatttaacacttcacctattatggttatttaagtaaaatgagttttcaaatatttcccccaggagaaatataaaggactatgcaaaaatagaaggagaaaaaggttagttagaggtccagaaggagaattaaaacatggaattgataaattcacctactgatttatgatgttaatgagcaggtacctatacattttatttacttgaaaacattttggccattaactatttctgttttctaaatacatttgtgtttataaaattttaaaatctatatcacaagccttagacatgcctttctttgcaataaagtatatatacctttttacaaatgtaaattttattttgaaacttggcattttctttataattcctaagatatctttgggcacacagactacagataaatctatttaaatcaattcatcattatcactggtttaaatatttaatgtaaccattggaatttttattcttattccttcagagaatcctccttttcttctatgtttctgactgcaatacagcccgatattgttattccctatatcttaatgaaaagcaagctgtcagcaaaatgcatttatagtttccagatgtttaacaatctctttcttcttttcttttttgttattatttttatttatgtgaagttagttagctgaggtaccaaaaaagagacaaagacagtattaaaaagtgtgcataaagcacttatttttgtactttagtacaatgttttatagaactttgtgatctatctaaatatattaagtaaaattacaccattcacttgttgggaaaataatctttggtttggaagatattaacataatgggcatcttagaatcataaatcacatgaaatgagagacaatgcaatattgtataattcctggatgatgcaattgttttaattgaattttcaagtgccattataaagttttaaaaattatcaa

SEQ ID NO: 733345 - DNA, 818 bp, Homo sapiens
cagaaacaatataaaaagctttcagaaaagataaaaatattgtatttctctagtctgttcactctccagtgtctctggttctttcatatcatcttcctttcctcaaatcttttaatactccctccctcatcatttccaactagtgaccctactttctatttcattaagaaaacagatacattcagaagagaactgccagtttaaagaacatttacaaagccatcacccatgtaataaccagccagagcaagaaatagagccctttaataacctactcttctccccccaccactgatgacaccgctccctccatcttaggtgtagcccccatgctgacttttgtaataataatttctttgcttttgtttataagttttcttccttataagcatctctaaacaacagttttgttttacagatgttcaaacattaaatgctttttagacttggaattgtgactatcttgtttcactccacattgcttgtgagactcattgatattgcagatagctgtagttgatccatttttattgttgtacagtttaccattgtataaatataccatgatttattcatgataactttgaggaacattctggttgtttgcaggttttatttttacagttcattagttttattgatgtataataattgtatatgtttatggggtatatgtgatattttgatacatgtgtacaatgtgtaatgattaaatcaaggtaattgggatatccatcagctcaaacatttatcatttctttgcattgggaacattccaaatcttctcttctagctattttgaaatacacaataaattg

SEQ ID NO: 733346 - DNA, 570 bp, Homo sapiens
  misc_feature (545)..(545): n is a, c, g, or t
  misc_feature (558)..(558): n is a, c, g, or t
tggagctcgcgcgcctgcgaggcacaggccagcccagctccacgaggactgaacaaggtgctgtctcactgccaccatgccggaagtcgagagaaaacccaagatcactgcctcccgcaaactcttgctgaagagcctgatgctggccaaggcaaggaatgctgggagcaggagcacgaggagcgcgaggcttgagaaggtgcgctacctgtgcagagcgcatccccacgctgcagacccgtggcctgtccctcaagtgcccttgcaaggaccttgtgcccgggagcttgcacgccaaaggtggaaggttgggtggattgaaggaagcgattaccgacatttgaaggcccaaattgcctccaacaaacacccagggaagatttaaggaccttgaagcttgaaaggtgaatggaccttccgttgggaagttcaagcgcccgcccctgcgttcgagtccgtgtctcggctgacgccatgctccgggccctgctggggtccaaagcacaaaggtgtccatggatctgcggggcaacctcaagtctgtnaagaaggaagacncagagaaggagc

SEQ ID NO: 733347 - DNA, 404 bp, Homo sapiens
  misc_feature (290)..(290): n is a, c, g, or t
  misc_feature (294)..(294): n is a, c, g, or t
  misc_feature (300)..(300): n is a, c, g, or t
ccacacctctgcagagagaatggccagcaggaaggcggggacccggggcaaggtggcagccaccaagcaggcccaacgtggttcttccaacgtcttttccatgtttgaacaagcccagatacaggagttcaaagagccttcagctgtatcgaccagaatcgtgatggcatcatctgcaaggcagacctgagggagacctactcccagctggggaaggtgagtgtcccagaggaggagctggacgccatgctgcaagagggcaagggcccatcaacttcaccgtcttcctnacgntctttngggagagctaattggacagaccccggggagccatcctgagtgccttccgcatgtttgacccagccgcaaaggggtgtgacaaggatgagttcaagcagcttctc

SEQ ID NO: 733348 - DNA, 344 bp, Homo sapiens
  misc_feature (221)..(221): n is a, c, g, or t
  misc_feature (265)..(265): n is a, c, g, or t
  misc_feature (277)..(277): n is a, c, g, or t
ccacacctctgcagagagaatggccagcaggaaggcggggacccggggcaaggtggcagccaccaagcaggcccaacgtggttcttccaacgtcttttccatgtttgaacaagcccagatacaggagttcaaagagccttcagctgtatcgaccagaatcgtgatggcatcatctgcaaggcagacctgagggagacctactcccagctgggaaggtagtntccagagagagctggacgcatgctgcagagcagggccatcactnacgtctctagtnttggagagctcatggacagccgagagcatctagtcctcgatttcaccagcgcaagggtgtacagata

SEQ ID NO: 733349 - DNA, 382 bp, Homo sapiens
  misc_feature (146)..(146): n is a, c, g, or t
  misc_feature (259)..(259): n is a, c, g, or t
  misc_feature (303)..(303): n is a, c, g, or t
  misc_feature (315)..(315): n is a, c, g, or t
ccacacctctgcagagagaatggccagcaggaaggcggggacccggggcaaggtggcagccaccaagcaggcccaacgtggttcttccaacgtcttttccatgtttgaacaagcccagatacaggagttcaaagaagctggggctnctcccacctaaggccccattccacaaggccttcagctgtatcgaccagaatcgtgatggcatcatctgcaaggcagacctgagggagacctactcccagctgggaaggtagtntccagagagagctggacgcatgctgcagagcagggccatcactnacgtctctagtnttggagagctcatggacagccgagagcatctagtcctcgatttcaccagcgcaagggtgtacagata

SEQ ID NO: 733350 - DNA, 292 bp, Homo sapiens
ccacacctctgcagagagaatggccagcaggaaggcggggacccggggcaaggtggcagccaccaagcaggcccaacgtggttcttccaacgtcttttccatgtttgaacaagcccagatacaggagttcaaagagccttcagctgtatcgaccagaatcgtgatggcatcatctgcaaggcagacctgagggagacctactcccagcttggtgcgtgcaccaccttccaccctgcgcacttgggtacctactctgagcttcttgcggtggagttgcttgggacaagacctg

SEQ ID NO: 733351 - DNA, 362 bp, Homo sapiens
  misc_feature (146)..(146): n is a, c, g, or t
ccacacctctgcagagagaatggccagcaggaaggcggggacccggggcaaggtggcagccaccaagcaggcccaacgtggttcttccaacgtcttttccatgtttgaacaagcccagatacaggagttcaaagaagctggggctnctcccacctaaggccccattccacaagagctgggcgtgctccaccttaaggcccctatcccaaaggcctttagttgtattgccagattgtgatgcatatatctaggagacttaggagacttatctcagttgggaggtagtcttagagagcagttgaggatgcttaagagcaagccccatattcaagttcctagttttgggaaagttatgcaacccg

SEQ ID NO: 733352 - DNA, 471 bp, Homo sapiens
  misc_feature (175)..(175): n is a, c, g, or t
  misc_feature (357)..(357): n is a, c, g, or t
  misc_feature (361)..(361): n is a, c, g, or t
  misc_feature (367)..(367): n is a, c, g, or t
ccacacctctgcagagagaatggccagcaggaaggcggggacccggggcaaggtggcagccaccaagcaggcccaacgtggttcttccaacgtcttttccatgtttgaacaagcccagatacaggagttcaaagaggtctctccccacctcccaccttccctagagctggggctnctcccacctaaggccccattccacaaggccttcagctgtatcgaccagaatcgtgatggcatcatctgcaaggcagacctgagggagacctactcccagctggggaaggtgagtgtcccagaggaggagctggacgccatgctgcaagagggcaagggcccatcaacttcaccgtcttcctnacgntctttngggagagctaattggacagaccccggggagccatcctgagtgccttccgcatgtttgacccagccgcaaaggggtgtgacaaggatgagttcaagcagcttctc

SEQ ID NO: 733353 - DNA, 760 bp, Homo sapiens; identical to SEQ ID NO: 613039

SEQ ID NO: 733354 - DNA, 823 bp, Homo sapiens
gtaacttgttcaagttgagtgattgaataaattaatgaatgtctgacagctagtgtggtcttggtcacaatcagctcttctggttccctagctggaaccctgagccctccagaactgattcactgctaataaatatcaattactctacagataaaggaagtggatttggactgagggtgcctggaggactctgagaaagggctctgacaaatgaacttccccaaagcaaaccctctttcccgtctgtgttaaagttggtgaagataaagatggttttctagatagtggctctggggacacactgaagactccatctcaaaaaacaaacatggtggctcacgcctgtagtcccagcgctttgggaggccgaggcgggtggatcacctgaggtcgggagttcgggaccggcctggccgggatgtttacaccccgccactcctgagcaccgcacaccggcttcctcccagtccctcatctgagaactcatgaagccacttggaatccctctctgctttgcctggctcattccatgtcaatttcagatcttcacttcaggtcagctccaaggaggctatccttgcccatcttcctaaaatagagctctcaaaacctggctgttttccttcagagcactggcctccaatttaaatcccaagtaaggtacctgccgtcggcagatttgagctttcttcttggacacctaatacccagagtcctccaggctccggtagattgcaaatgacctgctttctttctgttcccgggcggcatcggacccgtcggagagtaaatcccagtaaggtacctgcccgtggcagatttg

SEQ ID NO: 733355 - DNA, 1024 bp, Homo sapiens
tgaatctgaaggatgccttcatctgtattcccctgagtccagagtcccatgaagtgtttgcctttgaataggaagactctgacactaaagctaaatgatagtattgctggatgatgctccatcaaggcttcaaaaactcactaaccgtccgggggaaatacatgctaaggagttttgggacctccaattgaaaaatgagactttgcttatatatgttgatggcatattagaagccagcacaactatggcaaattgaccagaatattatactggctttacattttttttttgtctggatggggatccaaagtatccaagaaaaaaatcacaaatattgaaaaactcaattatatattttaggtttgaattttctcaggagcagagtaatctgctttcggactggagagaagctcttgtcagggtggccagactcaggacatggcagcagctgtgaggggtttttaggtatggctgaatgttgccatatttcattttcttattttgggcttatagcaaaatgtctctatgaagccctaagaccagacacttgacttctagaatggacaaggaatgtcaaaaggcctttctaaccattaagtaaaaattactaatggatctggctactgagaccccctgaactaagaaagccatttgatttgttcatacatgagagagaagggatgggtttaggagtagtaacccaagacttggggaatatcatgaggcctgtagcctacttttcaaaacagctggacattgttatgatgggttggacttcttatctctgaccactggcaccacttgtgatcttctccaggaggcagaagagttcactttgggttaacctagcactgtacacaccccacactgtgtatgctatttgttggaacagaagtggagctactgacttacctctagaagactgaataggtatcaggtcatcctcctggataatcctagtgttactttgagagctgtttctgctttaaatcctgctaaataaacctatacatgattgcatata

SEQ ID NO: 733356 - DNA, 838 bp, Homo sapiens
aggaacgagcatttgtcccttttgtccttctgccatttgaggaagcaacaagaaggcccttaccagatgctggtgccttgatcttcaacttcccagccttcagaactgttgcgttcccccagtagacagacactgagatggaaatttgcataccgaaggtggattgaggattgtttatctgaaaaaaacatctatggtggagtaagaaaaatcacgactgggctatggagaaagctgaactgggatgcagaacagaagcttcagcctcactcgtggggagctctggcgctaaaaaaactcatcgaagatttcccaaattggaacaaggcctctgtactcctgcattgaccagtcatggaaagcaacagtgtgttcagcaagctggaactaaactgttcctgaatggagagttcccatcctgcctcagtggaatcaaagaaaagagaaaggctccaaaatgaacacaatgcgtgttatttgctaccataaactgtgcaactggtttctactgctgtgttgcaattgaatagtaatcaggagaagttacacgttgttcttagaaataatacaacgaatcctgtcaatcttaagtcctgacactgaatttaacgctctctgtttagtcctaccatcaaggatgatttgcaggtgaagaattcttgatagtcagatgcagactacgtcttcagatcctatggcctaaggttattaaggtgggagaagcaaaacaaatgcggttctcatccagtaataatggatttacaagaatttgaaacaaaactttccttccagctactgctttcatgtcagagaaataaaatacatgtacaagatttaa

SEQ ID NO: 733357 - DNA, 1375 bp, Homo sapiens
  misc_feature (472)..(472): n is a, c, g, or t
aatgaaatgctttgctacactggatccttttcaacttagcacttacaaatataggtagcttttgcaacactaaactgcattctaataaacagcattcagctaaatgacatgttagttacccccttcctcttccccagttgatgcctcctaagagccgactgctattcttgagaacaaattcctggatactggcattagtgacaaagaagtgtcaggacagtttgccaagaatgttgtttcttcttgtacaacacaaagcaaggaaacctctgtattttatggctttgaggttttaaaaaatgttctgcagtttgattgatatggcttttaaattcagtgaatcactttcatgaatactgaagtaggtataatcttcagaactagtaatcattatagttacagataggattccatcgcatgtcctgctcaaatgaagacctgttctcattaatcaatactgcatgaaaatatnactggctcacactaaaattaggagcatcaggtgtccagagttttcctgttggggttcagatataaaatctaagtttctattgaggttaataagctggaagcatttgtttcctttaagccttggagaggtcattttcttactcattgatagcttatgtctactgaatgcaatattcttttctgttcagggattttggctgcattatgatttggttatgacataactcagttaaggaatatatttactaatttccaatgtagtctatgaggttcatttaatgtttttaaattttctatgtgtgtggctagaaggcatttgtagatatgcaaatatttgttataatcctgatcccttttataatttgagttattttcttgccctgggggtttacaaggacacgagtgcaacactctttatatggagaagacaggaaatagaccttgagctctaaacctttgcctgaccccctcttctgtgggcctgtgtttctggacaatggggaggtttacagccagtatgagcagagcagactgggagcacctcaatcctcatgcttatattagaaaatgccttagcaatgttgatgggctccttgtagcactggagcatggggagggaacaagctcactgatgtcatttatgcctattgtcttcagtaacttagaacttattatggtatattaaatcaataaaatgttggtgatgaaaaatgtgttttgtaaccataaggctgaaagggacttccaggaatatccaatctatttctctcactttttataaagatttgtctaagcaactactctaaacacatatttattatctccatacttaagaatatctacgggaagcatatttgaaaagcatcattggaaatccacctcaatactagtgataggcctggag

SEQ ID NO: 733358 - DNA, 827 bp, Homo sapiens
gagaattagacatttaataaaaatgccaggtgttccttgtcctcattcttccatatttgtcttatatatgtttagcaaaataattgagttaaatatgagcttttatgcttaagcgatggctgtgttttcgctcttaataaaattgcaccataaaatttgatttttagtgccaaaattataaaaaggggttgggcttgtttcctcaacctgaacaacttcttaccttcaagatggatgattcaaagaggaataatagggaatttcttagtatgaagttacttggttgttttcttaggaaaacaaaaggtagaatttaacagcatggggcctgatttaaatagaaaataaatgtacagatataatcaactctgctgtcatggggatttcaagttataaatgcaataagtaacatcccctgacttattctatgtacttttgccctaatctactacctattagtctgaaacttgagtttttaaatttaatctctatgtaaaagaggaataaattgaatgcataattaaaatatatgttgtcaattatcacacctttttgcctagactataagcttcatttttcctgttatatccactaaattaatttatgcttgtttttccattaaaacaagttactttggctgggtgcagtgactcccgcctgtaatcctagcactttgggaggctgaggtgggcagatcatgaggtcaggagttcgagaccagcctgtccaacatggtgaaaacctgtctctactaaaaatacaaaaattagccgggcatggtggccggcacctgtagtcccagttgcttgggaggctgaggcaggaga

SEQ ID NO: 733359 - DNA, 1267 bp, Homo sapiens
gctggtaaaaagttggaatagctttcgttaagcgtcggatgtgtagagtgctgagttaggggctggactagagacgttgggacatctcccgggaacagcagcctggaggggaaaaatctcctgacctaagtggtcattcggccttggcgcttggacacgggagtgcggcgacagccatatgtccatccatcttggcacttttccgtcctctgcctttgaagatgggtgtgcccggcaggctgtgaaagataaacattagagggttgtttagaagacttttttgacctgagcccatgaggtgcataccctttgtttggcggagaaaccagtggcttctgaagatcagggacgggccacaagtgcgaggcattgcagacatttcgaacccagacttccagcctggagacatccacacgcttccagtttcttgcactggtacttcattctgtcattatgattgccaccactcgtaactgagagttgcgtgccctcaagttttgagtgtctgcagggtacctttgagctttcttagctgtgtagtgagtggggggaatggagaaaatgaaggacagatgactgatttgtagtttttcatttggacactgtccttgccgcacaagcacagcagcttgaacctctttgaacaagagtcgagagttcttttacagctaattacccactagttaaacttgatcatactgtgctgttttcttcctctccattgtcaatgtaatacggctcctgacaaaagttaaattcgctgggcgtggtggctcacccctgtactcccagcactttgggggctgaggcgggtggatcacctgaagtcaggaattcaagaccagcctggccaacatggtgaaaccccgtctctactaaaaatacaaaagttagctgcgtgtggtggcgggcgcctgtaatcccagctactcaggaggctgaggcaggagaatcgtttgaacccgggggggcggaggttgcagtgagctgagatcgcgccactgcacttcagcctgggtgacagagtgaaactccgtctcaaaaaaaaaaaaaaaagccgggcgctgtggctcacacctataatcccagcactttgggaagccgaggggggaggatctcgaggtcaggagttggagaccagcctgaccaacatggagaaacctcgtctctactaaaaatacaaaattagccaggcgtggtggtgggcacctgtaatcccagctactggggaggccgaggcaggagaatcctttgatcccgggaagca

SEQ ID NO: 733360 - DNA, 984 bp, Homo sapiens
gctggtaaaaagttggaatagctttcgttaagcgtcggatgtgtagagtgctgagttaggggctggactagagacgttgggacatctcccgggaacagcagcctggaggggaaaaatctcctgacctaagtggtcattcggccttggcgcttggacacgggagtgcggcgacagccatatgtccatccatcttggcacttttccgtcctctgcctttgaagatgggtgtgcccggcaggctgtgaaagataaacattagagggttgtttagaagacttttttgacctgagcccatgaggtgcataccctttgtttggcggagaaaccagtggcttctgaagatcagggacgggccacaagtgcgaggcattgcagacatttcgaacccagacttccagcctggagacatccacacgcttccagtttcttgcactgtaaatcctgctgctgctcactctttgggtctgcactgcctttatgagctgtaacactcaccggaaggtctgcagcttcactcctgaagccagcgagaccatgaacccaccgggagaagagaacagtgctgtctttatgagctgtaacactgtaacactcactgcaaaggtcgaaggtctgcggcttcactcctgaagtcagcgagaacatgaacccaccagaaggaagaaactccggatacacctgaacatcagaaagaataaactccggacacaccatctttaaaaactgtaacactcaccgcgagggtccgtggcttcattcttgaagtcaacgagaccaagaacccaccggaaggaacaaatttcggacacaataggaaatctctaaggtggaatactatatcaaaagagagaagccaaaatgatatcatacgctgaaaatgttaatggaattccacaaccttgcctattaaaaactccacagtttgagcacagcatggaatcaaaatttaaaaaataaacatgacatagtatttttatcatttga

SEQ ID NO: 733361 - DNA, 1119 bp, Homo sapiens
  misc_feature (13)..(13): n is a, c, g, or t
  misc_feature (57)..(57): n is a, c, g, or t
  misc_feature (64)..(64): n is a, c, g, or t
  misc_feature (79)..(79): n is a, c, g, or t
  misc_feature (121)..(121): n is a, c, g, or t
  misc_feature (155)..(155): n is a, c, g, or t
atacaactcaagnatgagacaagtcggcaaggtgtgaagacggaagccactggcagngtctgcncccgtcccgtgcggnggccatgcggcgtgctgcgtcggcttgggacggacgagcgcnctcagatccgcgcagactctcgctggctccgcgnagcccagtggcctgggcgcccccgcgcgcgggttaagagcaggggagccgggcagaagaggaaggagcccggccgccgcccaacaccgccccccgccccacgccccgggagacccggcccgagcgccgcgggcaccgccctgaacctcttcgaggccccgctgcgggcgtccagagctggggactgtgggtctgactcctgcgttccagccgtgggtgccacctcttgcgggaagcagggcaaaaccactttggtcaggcgctcctcgtgcctttctcccttcgtaggtgaccagcatctcgtaagaatgataaccatcagtaaccgggaccccaaaccttctcatcaaggcacctctcgggtcaccattactttaactttgaatttgggtctccttcatttttccgctggatgcgttaatgtgcgcgacccacagctccaggcggcggtttcctggcggaactggaccaccgccacaggctgggggtctgcagtgggggatgggaccggccgcggccgccggccccttccgcgtccactgagccggcgctggttcggcgctgggatcctgcaccgggcctctctgcttggtgctgcgcgtctgcctgagagtaggaggttgctcccagctgtgccggccccagcagaaggctgctggtggtggtgctggggcaggtcggccttgaatccatgcgacaggaagggacgttaccagaagagattcatcgctttctcttggtctgggcagcccgggccttttgagggtgggaccgctgctacccccacccccaggttctttgcctgcctgttgactgccggtgtttcatgttttgtttctctgtttcactattttttattttttgccttaaaaaaaaaagtattaccatgcagcagttgcccatttattttaatttactattaatagtgtgattgctgtgtttcctcctacaaacactgaagcctg

SEQ ID NO: 733362 - DNA, 922 bp, Homo sapiens
gttgaggctgagggaggtcacttggccttcgcgacacgtgaggcgcttatcaggagttctcagtaggaagcgctttcctgcagcctcaggcagagaccgtgcgtgcaaggcgggaccgaccgcaggtgcagaggccccgggcctgcccaagatcgaattggtcgcaaatacgttccctcgccagaaactttaaaaggccagaagaaaataaaccggattcagctccctctcatctccaaatctcggtgaccagcatctcgtaagaatgataaccatcagtaaccgggaccccaaaccttctcatcaaggcacctctcgggtcaccattactttaactttgaatttgggtctccttcatttttccgctggatgcgttaatgtgcgcgacccacagctccaggcggcggtttcctggcggaactggaccaccgccacaggctgggggtctgcagtgggggatgggaccggccgcggccgccggccccttccgcgtccactgagccggcgctggttcggcgctgggatcctgcaccgggcctctctgcttggtgctgcgcgtctgcctgagagtaggaggttgctcccagctgtgccggccccagcagaaggctgctggtggtggtgctggggcaggtcggccttgaatccatgcgacaggaagggacgttaccagaagagattcatcgctttctcttggtctgggcagcccgggccttttgagggtgggaccgctgctacccccacccccaggttctttgcctgcctgttgactgccggtgtttcatgttttgtttctctgtttcactattttttattttttgccttaaaaaaaaaagtattaccatgcagcagttgcccatttattttaatttactattaatagtgtgattgctgtgtttcctcctacaaacactgaagcctg

SEQ ID NO: 733363 - DNA, 4135 bp, Homo sapiens
  misc_feature (1003)..(1003): n is a, c, g, or t
  misc_feature (1745)..(1745): n is a, c, g, or t
ctaataaaaatagtttattattttgaatgatttaatggttttctacacaatttacatcacaacatgtaaattttagcagtaacatctgattctaacagcacatcatgctattcctttcatagagccttcagagattcaatgctaaacaaatttccttagttggcatcaaggcactgatcactttagaggcttttaagaaattatttaaagatgcaaatgcctctgagtgaagtgtactatcccatcactgaagcccacaggaacaagtcctacaattttaaaaaggctcgatggaaaaatttctcaatcctgaaatcccctagggaaggggtcaggagaaagtgccatggttgatatttaagaactccacagctcttaaaaataagcacttatccctaacatgcaatactgcagatgcaagttaaacttatctgttaacagctgcctgctgttttctgctcccagatgaaatgaagcaactcttctgataacgaagagatacctgtctgaggcaaacgaaacattggcacacagcacagcctcctcaatccacttgatcccaactcatctctcatttatttcggcttcttttattccaggattaatgtagtgtaacattttcatttcttttcgcttttattctgcttttgtaaaagcagtattttgagatggacattgcctcttcattgtatttctcatcaattcattatttttgtggttatagcttgacaagcaattaactttaaaatggtagattccgtaactttaaattggtagctttcatttgcttaaaattttttggcatatgcagataatgttctcatcagtagtaagaatctcagggttatgcttattccccaatggaggtatgacatataatcttttctgcctttacttatcaattcaccaaggagctgttttctctgcatctaggccatcatactgccaggctggttatgactcagaagatgttatctgaaaaaagtctatagaaaaaaaaaangtttcccctccctcatcaacaaaagcccaccctctaagagacattcaagctgaactatcacaattcttaatcagttacaatttacaaacagataagtttaaaataaacaatttacaaaatttttgaagcataccttaacatcttgttttgcagttaaacaatggaaaagtatttctcctacactaaaaaaaaacttgcttacacacaactgaaaatagaatcttacttgataatacaaaagctaccatcagaagaaatcccttcaggatcattaagccacttcctttgctctgcagtttctatagtagttttaaattattattaaatcacctgaaaaaaattccaaaagagaaccacacactaccatatccaaacaacttttgcatttcccataattgtagttaatgtcagcccagtaggccagaccaacccccagttcaatactttccttccccaaaagctctatactttgaaggaaaacagatacagtatcaaattatgacactttccttgcccaaattaatgcactggtacacccagtggctcatatttaacttcccccagcttcccaattcaaactggggggaaaaaaactaaatcattgggagttacttgccaacttggaagttgatatttctttactttttccattctaagactttaagttctctggcatgagtttatctgcaatcataaactaaacaattacctaaacccaccccaccaatcccaaccgtaacangccactgccaactaattgccaatatttgcccctcccctttaataaaacttttaagaagtcacattattggaaaacttaacttcaacatttggcctactcaagctcttctgaagttctcctgagatgactgaatatgaaccaaagctgcactgtgctgtacttttcagcttcaactgggaatactcttccaaggataaaagcagctccagtccctgaaggtgttcgtgccaacagcacagcggtacactccttctctaacccagtttgtcaatagtactatagcatctgtggaaaatcttagaaaaaaacattttctcccccaccctctctcttccctgttaagaccatcccaaaatgcttcaagtaaaaaataacaagtttaaggggttaagcacttttaaagtctgattaagggggtggggggaaaaaagagtaactaccagccatttctccaatggacatctcttccacagacctcaacgtgagaactgctctagtttctataaactgtaaacctgtggtggtctgattatcctgatattggattttcttgttttctgttacaccttgagtcatttgcctttaggattctagacagacctaagggaaaaagaactgaaaacatattttgcccccacccccacaaaaaaaaatactgaaaactcccccccgcctcagttacacatccaaactctacatttacaaaacgaattcagggtgaggaagtaaaaacaggtcatctattcacaaaactgaaatacttcattaccccaactaaacatacaaactgcttacagatttgctgaaattgtctcaatttggctatcaaattcatttggttttcctcaaattcgtgtaaaaaaaaaaaacccacaaacttgccatctactatttctccaggacttggcagtctgccctcaaaagcttcagacaagattcatgagtataagcctgaaaaagagaaacctacaacacccggaaatcggcctacgtccccatataaatccctttacacctcagtacgaaactcccccattatattagaaaataaataaaaggttaccataagtaagttccagaaaaacaacatatgccgacctcacggatttttaccaaccactcgctttccctgtggccttggcacactggcatgctggtctaggatcctctacgcacaacgcctgctcgcctcctccgtgtggttgccaagccaagccgcctgctaccttcatcaccaaattgcactcgctccttcctggaatcctttttcctagcttcaccaccaaatcgttagcgctccttccttcttcctagcttccttcaccaaatcgcactggctcctggactcttttcctatcttcaccacgaactgctgcttgctcgcttgctcctcagtcctagcttcatcaaacactggttcctggaatcctgtctgctgctgtcttcctagattcactgaatccacttctgtgtagcacctgggtcagctgtcaattaatgctagtcctcaggatttaaaaaataatcttaactcaaagtccaatgcaaaaacattaagttggtaattactcttgatcttgaattacttccgttacgaaagtccttcacatttttcaaactaagctactatatttaaggccttccaaattcttctaactcttccaaaagccttctgccttagttttttttaaattacaccagtccttttagtagctttttgatgtgatttttaaccaacttccccttctagcttcaagtattcttctaaattggttctggtctacgtaaacaccctcatcttctcaagctttaccttctaacttctgcaccaccagaaattaaattgatgggcttttaaaataaattggttaccaataatttcctcattttttcagtgctattttatccaatttttggctttatatttttctatcttctatacttctccaatacttgtcttagcttgtttttcattttctatctgaaactcttgacaatattttcattttctatcttgtttctatcttccaattttcttctaagtttgtacattttgcccttagctttttgtttcctagcttgtcttttttcttctgcttcctacttttcaggtttaaatttatcttttttcttctaaaagtatgtttttatcttctaatttccctatcttctctattcttttcttcgccttcccgtacttctgtcttccagttttccacttcaaacttctatcttctccaaattgtttcatcctaccactcccaattaatctttccattttcgtctgcgtttagtaaatgcgttaactaggctttaaatgacgcaattctccctgcgtcatggatttcaaggtcttttaatcaccttcggtttaatctctttttaaaaga

SEQ ID NO: 733364 - DNA, 3468 bp, Homo sapiens; identical to SEQ ID NO: 27295
  misc_feature (69)..(69): n is a, c, g, or t
  misc_feature (854)..(854): n is a, c, g, or t
  misc_feature (1302)..(1302): n is a, c, g, or t

SEQ ID NO: 733365 - DNA, 3331 bp, Homo sapiens; identical to SEQ ID NO: 27296
  misc_feature (69)..(69): n is a, c, g, or t
  misc_feature (717)..(717): n is a, c, g, or t
  misc_feature (1165)..(1165): n is a, c, g, or t

SEQ ID NO: 733366 - DNA, 2512 bp, Homo sapiens; identical to SEQ ID NO: 29678

SEQ ID NO: 733367 - DNA, 2088 bp, Homo sapiens; identical to SEQ ID NO: 29679

SEQ ID NO: 733368 - DNA, 398 bp, Homo sapiens
  misc_feature (2)..(2): n is a, c, g, or t
  misc_feature (17)..(17): n is a, c, g, or t
tntttaatacggactcncctatagggggaattttggccctcggagggccaagaattcgggcacgagaactggacgcaacctaaacacaaatgagggaggtactggcttctgcctcagggcttctgcacatgctctcttcccttgcactgaacactgccctcaccccctgcccacatcttcacggttcttaagttgttgctctaacgccacctcctctgcgaggcccgcccctaaccactctacttaaaaacagcaccagactgggcatggtggctcatgcctgtaatcccagcactttgggaggccaaggcgggcagatcacttgagattagggagttcgagaccagcctgggccaacatgacaaaaccccatctttactaaagatacaaaaaaaaaa

SEQ ID NO: 733369 - DNA, 1033 bp, Homo sapiens
gttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtgccaccaccaccttgttcctgcccatctttgcctccatgtctcgctccatcggcctcaatccgctgtacatcatgctgccctgtaccctgagtgcctcctttgccttcatgttgcctgtggccacccctccaaatgccatcgtgttcacctatgggcacctcaaggttgctgacatggtaacacagctgtttttatttactcccgtcggactataacgctgttgtcataagggatgccccatttatgaatgacagagtttcaaaacgatgtcatgtgacttgggaatgccacggaacatccagacctgtagccattgttgacatttataatgcagcttttcttctttttctg

SEQ ID NO: 733370 - DNA, 744 bp, Homo sapiens
cactggaagaaaaatgtttcccaagcaaccagctttattctagctgactcactttgtactccctccttccatgtcattgctcctttttacctctttaggagtctgttaggaattttgcaacctgacaaaaggcttctgcagagccaaccaccttttttttcctcagggcctgaaaaaaaagtgagtcttcctactgacaggaaaataaaaagagaccttgttagtcaatttttttctgtatgttcaattgttctggtatattcttttccttgagtataaagaaaagtctgaaaataatggtaaaagtgtgagattgctctgatatttcctttttgtactttaggaggtggttctttgagttcctagttgtttagttgaacatgaagcaggtggcaaatgtaagtttagtctacacactgattccttcctgttcgcagaagggttcatgtgttcgtttttaaataatcttcgggtaaggaatagagaaacaccaagcccaagaggcagaaggatctgtctatagctaatgagtgagaaactaactgtgggatggtttatggtctctggctctttgaaaccacagaaatttaaagttatttttaaaaagccaacttgactgggcacagtggctcatgcctgtaatcccgaggcaggcggggggccaaggcagacagatttcttgagcccaagagttcaagaacagcctgggcaatatggtgaaaccccatcttctcaaaaaagtta

SEQ ID NO: 733371 - DNA, 503 bp, Homo sapiens
gttgaggttgtgcttcttcaggaagtccttcagcaggccacgctcggacagggtgcgcctcaaggacttctttctgatgagggggaccctgtggtttggagaaggaagaggaattaggcaaggattctgctgaccgggtgctgtggcagccccagaagggaagggaagctggtctaagagaggaagaaggaaggaaaggagacgccccctcttctgcccaacaatgcaaagaagttaagttgactagtgctggagctgggagccaaacccaggctggactcttaaccagctgatctaagagaggaagatggaaggaagggagaagctcccacttctgccccataatgcaaagaagttaagctgactagggctggagctgggaaccacagtcaggctgggcccgagttttaaccatgtctgcagggctgcctcccaaaaaggcagagagagaggcggaaaagggggatggagacagctgaatagagagggagaaaaaagggaag

SEQ ID NO: 733372 - DNA, 2251 bp, Homo sapiens
cgagggggagggcggagctgccggcggcccgggcgggctggcagctagagtgggtgcgatagccgcctccgcctctgcccgcctccgccgtcgcctcctccgcccgggccgttcgctgctgcgcggggagagcgaggcggggccgccggggccgccatggagcccgactcggtgattgaggacaagaccatcgagctcataacacttcagttctggaagatcaagatgaagataagtccccaaagaaaaatactccttggcagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccagtttgataacaagaggatggtcagccgggcctatgatgggaaaattaaagtttaggacttgcaagccgctcttgaccctcgagccccagcaagcacattgtgtttgcgcacattggtggaacattctggacatgtgttttgcctacagtttgatgagtttcaaatcgtcagcagctcccatgatgacactattttgatttgtgatttcttaaatgtgcctcccagtgcccagaatgagacccattccccctccagaacatacacttacatctctagataacagtctgcactttcacccgtttccgggttttctagtcttgaactactggctacgtggctaccaatgcctaagggagttcgttcacagctgagttatgaagctggaattggttctagacgctgggtagatgcaaagcagcctaactcttcaagtcccgacatttctcacctctgattccagctctactttgagaaggagaccttagcttcactgacttgaaagtagcacagaagcccgtttccttccctcattagtgaaaaaatctaatgtttcaaatgtaaactgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattc

SEQ ID NO: 733373 - DNA, 2291 bp, Homo sapiens
cgagggggagggcggagctgccggcggcccgggcgggctggcagctagagtgggtgcgatagccgcctccgcctctgcccgcctccgccgtcgcctcctccgcccgggccgttcgctgctgcgcggggagagcgaggcggggccgccggggccgccatggagcccgactcggtgattgaggacaagaccatcgagctcatgtgttctgtgccaaggtctttgtggctaggctgcgccaacctggtagagagcatgtgcgcactgagttgcctgcagagcatgcccagtgtcagatgtctccagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccagtttgataacaagaggatggtcagccgggcctatgatgggaaaattaaagtttaggacttgcaagccgctcttgaccctcgagccccagcaagcacattgtgtttgcgcacattggtggaacattctggacatgtgttttgcctacagtttgatgagtttcaaatcgtcagcagctcccatgatgacactattttgatttgtgatttcttaaatgtgcctcccagtgcccagaatgagacccattccccctccagaacatacacttacatctctagataacagtctgcactttcacccgtttccgggttttctagtcttgaactactggctacgtggctaccaatgcctaagggagttcgttcacagctgagttatgaagctggaattggttctagacgctgggtagatgcaaagcagcctaactcttcaagtcccgacatttctcacctctgattccagctctactttgagaaggagaccttagcttcactgacttgaaagtagcacagaagcccgtttccttccctcattagtgaaaaaatctaatgtttcaaatgtaaactgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattc

SEQ ID NO: 733374 - DNA, 310 bp, Homo sapiens; identical to SEQ ID NO: 34262

SEQ ID NO: 733375 - DNA, 5243 bp, Homo sapiens
gcagttaagtatttgtttaatcttgctttgtcttttcaaacagcgatttagtaatcctgtttgaggctgcagtgtggcaatgctttccagaggatggagtcctttttgtttgttttgaaaaaatagagatggggtttcactatgttgcctaggctggtctcatactcggcctcgagccatcctcctgcctgggcctcccaaagtgttgggattacaggcgtgagccatggtgccagactggagtccttttattaaaattaactgccctgctcagctttctgctgggccaccccagagccaatccttggttcttgggcccaaggctggacccaggggttgcaggaaacagtctgtagcatccaagtggggcctgtcgtacccactccagtgtgtaggtgcagaacgctctttgggggatttctctgctgggccaccttactccagggatccctcagttttcaaaacaaagcaagagggcaaggaagaatggagaaacagctcagtgttgactctcttccccctggtgagtgctgtgctggggcctctgtgcacatcataccacttcccccttgaatcagccccacaaggcagggtgagagatgaggactcagggtgcaaggaggtctcacagcttggaaatggatcaggacagctctgattctccaaggccaaggtcttctctatatcatgaggcagcccaaaaatgtgtttctacacatattctgtgtagaaactcaggccaggctcctatatgctctgggtgacagcgggaaggtgctttccagtgtgtatcagtgtggcccatctgggagtcataatgtcattgcctcttccaaaatatcagcaaagctgaccctagtgcttgtagtgctcaaatgcacctctctgcctttgtgccatagggaaatggatttggtcctgggggtggtgataccaacttctgtctcaattccatgaccctcactcagcacccccaccccaggcctgtgcagaggaggaataaccgtccttgagaaccatccagccctaggtggagaaattagatttatggacttaatcagttcttcttccctgtcagtggtggtgagaatgacatgggggaaattgataagcctcagtcatgttttcctgcgagacaaggcagctttggtagctggtgggactgacgccttcttcacctgtgtcctctgcctctgagtgactataaattgcgaaccccatgaggtggcacctgcagccacagatcgcttaggcaccttgcacagggggccacctaatgaactggctgcaggacggcaatcctgccgtgaagccaggcacctcgggaggggcaaggtggcagaaccgagagagcagatgctccttgctgtttctgtaaggccaccagtggctgggtggcctggccctggtagcaaggtggtaaccgtgtgagtggctgaatcctgcaccacttttcctgagcctccttcctcctggattcctgcaactatattctcactacatggctcaccaccaattcgttctctctgccccaaggaggctggacaagaggctcaggtcagtgcgggtacgcaggaacctatgtctgtaaaatgaaaatgcctgccttcaagggctgtcttgaggttgaaaggagatggtctacatcaagggttaggaagaccacaatgtggctgtgccggccacctccaggctggcttcagtctcccatccccatagtcatacccctgtgaagtcccttcccatactgaatcgggctacctgtgtatcttatagggtgttggaaatgacagattgtgaattccaaggccccataaaagacagcgtgggctgggcgtggtggctcacgcctgtaatcccagcactttgggaggccgagccaagtggatcacttgaggtcaggagttctagaccagcctggccagcatggtgaaaacctatctctactaaaaatacaaaaaaaaaaatttagccaggtgtgttggcacctgtgcctgtagtcccagatacttgggaggctgagccaggagaatcacttgaacctgagaggtggaggtttcagtgagccgagattgtgccactgcactccagctgggtggcagagactctgtctctaaacaaagaaaatgtggtttctgctgtcctttctcttggatcactttctctgggaaaccagccaccatcttgtgaggacactcaagctctctggaaaggttcagaaatgtggtgaggaagtgagacagacctcttgccaaaaaccatgtactaacttatcagtcacgtacatgagttgacttagaaatgactctatcagcctcagccaaaccttcagatgactgcagccctggtcaacatcttgactgtgaccccatggaagaccctgaaacactcagccaagccactctcagcttcctgatccacagaagcagcatgaaataataaatttttcttgttttaaactaagttttgggttaatttgttatacagctgtagataactccaagaataatactccataaatgttgatttcctttctgcggctccactgagtcatctttgttcatgggcaaagctcactgtctctctactggctgcaaaagatgtccatttgttggctctgactcatgcttgtggtcttgttggctcacagcaaggccttttcacagaggatggtggtttgtcacactcagaatccaggtcttacctgctttcctgctccatggaattttgacctgagtttgaaggctgataggggattgatggatgagggagaaagacacagtcagttcttagagcagtagctaatccaggggtttctctggctttgtttgcatgagtagtgatagttggggatgaagcatgggtattcgagatcttttttgtgtgagtatgggaggaaaaattctgttctcttcctcctccatctttattcatctttgtcttccctcggatcagctttaaagacccctgagactctaggactcggtttgcttttttctcaccactgggatccatctcccactagtaggaagaaggatctaagtagttgagctgcataaaggggaagtaaacagccagacaaatgttacattttagagccttgagtgacccagagctttctatcagcttcattgggtgcagggagggtagcgatttctggctgctgtcacctccttgctcatatcaggaagcgctaattttgaggcaaagttcagtgccctctggctcacctagggcccctgttgcctaatttcacgaggccaagagtttgagggtgggttcggggctgcgcagcctggatgccttggtttgcatgcctacagcagctgtgcccgaaagctttttttagagtaaatatgtagcttttgctaggctttttgtgtgccttgttcattcctctatcattttttgtatacctgctatggtgtcaggcactggggatacaaattagccggggactcggacatgtaagcaagtaagcccaacagcagctaacatttatgcagtgctcactgtgtgcttggatgtccagagtgatagagcaggtttagtaagggggacagagggctgagaccagaggcaaggtggagaagggcatttctggaggcagcaatatgagtgcaaaggagacatacacaaggttccctgggggattccaagttgttgctgtcgtggcttcaaatcttactttagggcctactcagatggcatcttgttcatgaagatgtgcctgttttttgttttatttgtccctctccccccaacaaagagtaaactttttttctgaacttctcgaaagtttgctaacatcagctataaaactctctgggcctgggatattttgcggggagcagggaagatctttgattatcattttaacttatttctgttcatttattcaagctttttcttctttcaccaattctcaaaagccccacaccaccctcctgccaaccccacacccctccacttccagtcgctaccttccacccatcattctcacttctaaagccatcaacagaggttttgaacaccactcatgtgccaggtgttgttctaagcacagattcatcagtgagccaaatgaaattccttcctaaaatatgctctttggtggtgctaaatgccaggaagaaaagtaagcaaggggagggaagagagaggtgtggggtggcggggggcgggagcttggataggatggtcagaaaggacctctttgtagaaacttaaataaatttagaaagcaagtcatgtaatatctgggaaagaggaaatagcaggtgcaaagaccctgaggttgaagtgtcctggcaagtttgaggcaagcaaggaaggcagggtggttggaacagaacaagagaagaaacgtggtaggaaatgatggagagtcagggacacgaccttggaggacttgcaggtcatggtaaagacgctggactcgacacgaagtgtgaacagagttcttggaggattctgaggtagagagtagcataatctcatttgtgtttttattctaacatgctcacttgggccaccttgtagaggctagagtgaaaaggagggagactagttagaaattctgtattgctggctgggcgtggtagctcccggcactgtgggaggccaaggccagaggattgcttgagtctagcagtttgagcccagcctaggcaacatagcgagaccctgtctctacaaaaaattttaaaattgcccagggatggtggtgcacacttgtagtcccaactacttgggaggctgaggtgggaggattgcctgagcccaggagtttgaggctccagtgagctgtgattgtgccattgcactccagcctgggtgacagagcgagaccctgtctctaaaaaaaaaagaaaaaaaaagaaattctgtattgcagcagcctaagagagtcattagttaagagatttgtagtaggcattttttagaaagttgcattgagggctaggtacggtggctcatgcctataatcccagcactttgggaggccaaggtgggtagatcatttgaggtcaggagcctggccaacatagcgaaaccccgtctctactaaaaaaattagccgggcggtagtggcatgcgcctgtaatcccagctactcgggaggctgaggcaggagaattgcttgagcctgggaggtggaggttgccagtgagtcgagatcgcgccactgcactccagcagtctgggcgacagagtgagacgctgtttcaaaaaaaaaaaag

SEQ ID NO: 733376 - DNA, 544 bp, Homo sapiens
aatcagcttatacataagcaggacagcctgaaaagctactgtgaaatacagaaataggataaatatcctaacacctctttgaaaaaggcagcatgggatgaagatactttacttctaagaatatttattccttggccttttagagggttttcttttttggtggggagggagcagttggagaggaaagtgtgttgtcgtggctggagaagcaaaatgacagagacatggataaggggggagaccttcgaatgccccagaagtcaatgtaactcctataatatagccctacacagggcctttgctagatgacgactcatcagcaagcttcttaatatctgttactctgtgcccacctactaggaatgatgataggccttctggacaagttaccattgttattaactcaaaagatccagcaatacaatataaaagctcattaatctacaccttgttaactaataatctgtgatgtgttagacaagctggatatgtttacctatatattgctaagggtagacagaggaaaggagaagactaagttagc

SEQ ID NO: 733377 - DNA, 1621 bp, Homo sapiens; identical to SEQ ID NO: 37517

SEQ ID NO: 733378 - DNA, 1685 bp, Homo sapiens
ggaggggtctgtgcacacagcatcgagggcggagagctcttcgagaggattgtggatgaggactaccatctgaccgaggtggacaccatggtgtttgtcaggcagatctgtgacgggatcctcttcatgcacaagatgagggttttgcacctggacctcaagccagagaacatcctgtgtgtcaacaccaccgggcatttggtgaagatcattgactttggcctggcacggaggtataaccccaacgagaagctgaaggtgaactttgggaccccagagttcctgtcacctgaggtggtgaattatgaccaaatctccgataagacagacatgtggagtatgggggtgatcacctacatgctgctgagcggcctctcccccttcctgggagatgatgacacagagaccctaaacaacgttctatctggcaactggtactttgatgaagagacctttgaggccgtatcagacgaggccaaagactttgtctccaacctcatcgtcaaggaccagagggcccggatgaacgctgcccagtgtctcgcccatccctggctcaacaacctggcggagaaagccaaacgctgtaaccgacgccttaagtcccagatcttgcttaagaaatacctcatgaagaggcgctggaagaaaaacttcattgctgtcagcgctgccaaccgcttcaagaagatcagcagctcgggggcactgatggctctgggggtctgagccctgggcgcagctgaagcctggacgcagccacacagtggccggggctgaagccacacagcccagaaggccagaaaaggcagccagatccccagggcagcctcgttaggacaaggctgtgccaggctgggaggctcggggctccccacgcccccatgcagtgaccgcttccccgatgtgagccgcctcggagtgtggcctggatccatcctgctagcacctccccagacagggctccagcctgtcggccacaccccagactccaggcccccgttgaagccgctcccggttccctccccagctcctcgtctttgaactgccgccgccgtggtgacccctgctttgccccactgggagagtccttagcctgggcctcctcctagctggagtgccatggctggggggtctcagcatgtagggcttctgtggttgtggatgggaggctcctggtggggcagaaaggctgcaacgctgattcctaaggcccagctgccagggaagacagagcaggctttgtgagagaggacctccatgcccccgccacctccccactccagcagataaggccgagcccacaccatctggcccaggctggcccccacccaccttccttgcgaccaccaacacacaggaactctgtgtgagagagagggcgcccagcccaggcctggtggagggggaggggagaagccaagggacacaggagaccacccccgagcttgcctcagggccaagccggcccaacccaaccactcggggcccccatcttgggggtcacccatggcctcagatgatggggtcagcaggcccaggagaattaggaaggccatggggcagcctccagtctgctctcagcttgtgccttgtaaataaatgtacaggttggatgtggcctccttccctctgtgtgtgcctgcactggtgtgaggtcgctgatgaccacagttcactgagca

SEQ ID NO: 733379 - DNA, 2747 bp, Homo sapiens; identical to SEQ ID NO: 37518

SEQ ID NO: 733380 - DNA, 2683 bp, Homo sapiens; identical to SEQ ID NO: 37519

SEQ ID NO: 733381 - DNA, 547 bp, Homo sapiens; identical to SEQ ID NO: 40676

SEQ ID NO: 733382 - DNA, 547 bp, Homo sapiens
aaactctggacttcaagtgatcacctgcctcagccttctaaggtgctaggattataggcttgagccactgcagccaccactctgtatatctcttttgaaagtcataagcaatatctttggaaaaaacacttaaggttatttatttagaggtagtgtctcctctgtacccccagctggagtacagtggcacagtatcacagcttgctgcagcatcaaattccctaggctcaagccatccttccaccggacatgttggcgtgcacctcctgagtagctgggactacagttgtgctctaccacaccgggctaatttttgtattttttagtagagacagggttttgccatgttggacaggctggtctggaacacctgacctccggtgatctgcccacctcagtctcccaaagggctgggattaaaggcatgagccaccgcactcagccacttaaggcttttaaaaaatcaattaatttctaaatggttttggacttttgactccttataagtgttaagatattttggtatcacttttttccttccaaaaaa

SEQ ID NO: 733383 - DNA, 531 bp, Homo sapiens; identical to SEQ ID NO: 75590

SEQ ID NO: 733384 - DNA, 547 bp, Homo sapiens
tgttattggggagttgcgtttccctactattattgcgtggctacttgagtcttattgtaggtctagcagtacttgttgtataactctatgttccccaaagttgggtgcatctacatttaggatagttaagtcttcttgttgaattgaaccctctatcgttatgcaatgcctttctttgttttattttactattaatgatttaaagtccttttttcttaaaagagaaacaattccaggtatggtggctcatgccagcactttcagactgaggcagtaggattgcctgagaccaggagtttgagaccagccgaggcaacataacaacattctgtttgtacagattcttttaaagaaactatacaggtgtggtagtgtgcccaactgtggtcatatttactcaggagacataggaggcatgactgctttacttcagaaatttgaggttacagtgagctgtgattgcaccactgcaatctgtcccaggagatagagtaagatcctgtgtataaaatgaaaaaataaagaaaaataaaatgattttaagtta

SEQ ID NO: 733385 - DNA, 854 bp, Homo sapiens
  misc_feature (838)..(839): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctc

SEQ ID NO: 733386 - DNA, 598 bp, Homo sapiens
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggct

SEQ ID NO: 733387 - DNA, 1674 bp, Homo sapiens
tttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccagcgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgat

SEQ ID NO: 733388 - DNA, 1312 bp, Homo sapiens
  misc_feature (1296)..(1297): n is a, c, g, or t
ggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactccccgctactccaggaggctgaggccggagaattgcgtgtggggtgaaccccggaggccgagctttccgtgagcagagatgatgcccctgcactcccacctgggcgacagagccagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctc

SEQ ID NO: 733389 - DNA, 814 bp, Homo sapiens
  misc_feature (814)..(814): n is a, c, g, or t
ggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactccccgctactccaggaggctgaggccggagaattgcgtgtggggtgaaccccggaggccgagctttccgtgagcagagatgatgcccctgcactcccacctgggcgacagagccagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaacctgccgtgggggatgcgctctagn

SEQ ID NO: 733390 - DNA, 1343 bp, Homo sapiens
  misc_feature (1327)..(1328): n is a, c, g, or t
ggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactccccgctactccaggaggctgaggccggagaattgcgtgtggggtgaaccccggaggccgagctttccgtgagcagagatgatgcccctgcactcccacctgggcgacagagccagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccctccccccccgcccccgacccccccccccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctc

SEQ ID NO: 733391 - DNA, 885 bp, Homo sapiens
  misc_feature (869)..(870): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccctccccccccgcccccgacccccccccccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctc

SEQ ID NO: 733392 - DNA, 1248 bp, Homo sapiens
  misc_feature (1232)..(1233): n is a, c, g, or t
tttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccctccccccccgcccccgacccccccccccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctc

SEQ ID NO: 733393 - DNA, 1217 bp, Homo sapiens
  misc_feature (1201)..(1202): n is a, c, g, or t
tttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctc

SEQ ID NO: 733394 - DNA, 1074 bp, Homo sapiens
  misc_feature (1058)..(1059): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccctccccccccgcccccgacccccccccccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctc

SEQ ID NO: 733395 - DNA, 1043 bp, Homo sapiens
  misc_feature (1027)..(1028): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctc

SEQ ID NO: 733396 - DNA, 1500 bp, Homo sapiens
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccagcgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgat

SEQ ID NO: 733397 - DNA, 847 bp, Homo sapiens
  misc_feature (805)..(805): n is a, c, g, or t
  misc_feature (833)..(833): n is a, c, g, or t
tttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtctnacgccatcactctggatttatcaggatnaaatgggaccggcc

SEQ ID NO: 733398 - DNA, 3007 bp, Homo sapiens
  misc_feature (1232)..(1233): n is a, c, g, or t
tttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccctccccccccgcccccgacccccccccccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaacccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaattttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggcaaggattccatactttattttatgggtgattattgttccattgtgtgtataccatat

SEQ ID NO: 733399 - DNA, 2976 bp, Homo sapiens
  misc_feature (1201)..(1202): n is a, c, g, or t
tttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaacccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaattttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggcaaggattccatactttattttatgggtgattattgttccattgtgtgtataccatat

SEQ ID NO: 733400 - DNA, 3102 bp, Homo sapiens
  misc_feature (1327)..(1328): n is a, c, g, or t
ggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactccccgctactccaggaggctgaggccggagaattgcgtgtggggtgaaccccggaggccgagctttccgtgagcagagatgatgcccctgcactcccacctgggcgacagagccagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccctccccccccgcccccgacccccccccccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaacccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaattttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggcaaggattccatactttattttatgggtgattattgttccattgtgtgtataccatat

SEQ ID NO: 733401 - DNA, 3071 bp, Homo sapiens
  misc_feature (1296)..(1297): n is a, c, g, or t
ggagaatacctcccaacagtctccctcatgagctatctcctctgccaacaagccgaccaggccctcccaaaaccccacgaaggggtctccaatcccaaatagacttgctctccaattccaaaagactctttaagcagcagtgacacttcaaaaccatcgaggtttagatctcctcactgccgagaaaggcggcctgtgtatctttttagaagaggagtgctgtttctatactaaccagtcaggactagtacaagatgctgctggacgaataaatgaaaaagcttctggccgggtgcagtggctcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactccccgctactccaggaggctgaggccggagaattgcgtgtggggtgaaccccggaggccgagctttccgtgagcagagatgatgcccctgcactcccacctgggcgacagagccagactccatctccaaaaaaaaaaaaaaaaaagctgctgaaatcaggcagcgcctttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaacccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaattttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggcaaggattccatactttattttatgggtgattattgttccattgtgtgtataccatat

SEQ ID NO: 733402 - DNA, 2833 bp, Homo sapiens
  misc_feature (1058)..(1059): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccctccccccccgcccccgacccccccccccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaacccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaattttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggcaaggattccatactttattttatgggtgattattgttccattgtgtgtataccatat

SEQ ID NO: 733403 - DNA, 2802 bp, Homo sapiens
  misc_feature (1027)..(1028): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaacccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaattttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggcaaggattccatactttattttatgggtgattattgttccattgtgtgtataccatat

SEQ ID NO: 733404 - DNA, 2644 bp, Homo sapiens
  misc_feature (869)..(870): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccctccccccccgcccccgacccccccccccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaacccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaattttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggcaaggattccatactttattttatgggtgattattgttccattgtgtgtataccatat

SEQ ID NO: 733405 - DNA, 2613 bp, Homo sapiens
  misc_feature (838)..(839): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcacccagaacccctccccaccccaatgcagctgtcccttaccctgaatactctgcagctgcattcctggacccttatctaggcgctacagcaaggtcaccagacttgctttaaccctacgggcagcatgggggaggtcacgagaaacgtggataaacctaagttacaccctcttgtaaattcctatattgtaacctggtcacgagatgatatgtggtaaggttaaccaacaaacaaccccagggtctctctcccccatataaaaccctcattttgtaagctcagggctgcctcctttgactgtggtgaagcagcctggcaggttagtaaacttactctcctgannttgggtctctctctcgtcctttctctcggctaaccttacagcgccctcatccattctccaattataatgtgtttacacctttcctcctgcatgtctcacattttaccttgtcatcctcttacttgtgtatgtgtctatgcctcccagcatttgacagtacctgaaggtcaaagcctatctgctgtttacccttacaattctattcactcggcacgcactaggcacagaataaatgccattcatccctacttttacttcagggtacattttagagatctaagatttggtgtatctttcccattatccattcttattgcctcaaggctctcctcttataaatctagtggtatgcattactttgggggtaaggacaaatttatccagaacagagaagatttagttcagtctttagttttaaaataagcatttttaagtaatagcagagacaaaagtctgaaagccaacatagttttaatttaaaagaaatttgattttgctacagctttttggccaggagtaagtgaggatgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagagcccagcacacttcccttccaattgatttgtcctacacccctccatgagcctaagcattagagcagaaatgactgagggtagcatccaagccactgggccaaggggcactggtacgatgaggataccgtgtcccacaattccagggtagtctgggaaaaacaaagcagagttcctgagaagaatgcagtagtggctgacagaacccagaaagggtgttgtagtgatatgtggccatgacatcagaagactaaaatgaggctatggatattccctagcaaatgtcttgggaacagaggccaaagccgaaagctcaagaattaatggaatgactacacctcaacgaaggttatagattagtgaggactgatgagtacaaaccagactcacacatccatcctcatcctcactccccacccccaggctacaatattacatatatgtcccctactcctgagggatggaaaagaggatgggtaggataagttcaaactgctttaatggctaacaaaattcacctttattcctttttatttttagttgacatgtaaaaattgtacatatttattggctacagagtgatattttgatacaagtataaagtgtgtaatgatcaaatcagagtaattagcacatcaatcacctcaaatagttatcacttatttgtactgggaacactcgaaatccttttctagctttgaaaaaatatacaataaattattgttaactgtattcaccacatagcactatagaacagtagaacagaatttattcctcctatattgctgtaattttgtatctgttaattaacctctccctagcctcccctccccctacccttcccaatctctcataaccacaattctactctctagatctatgagctcattttttaagtccctgcatttgagtgagaagatgaagtatttatctttctgcgcatgacttgctttgcttaacataatatcctccagattcatccacgttggtgcaaatggcaaggattccatactttattttatgggtgattattgttccattgtgtgtataccatat

SEQ ID NO: 733406 - DNA, 1119 bp, Homo sapiens
  misc_feature (1113)..(1113): n is a, c, g, or t
tttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccagcgttcctcaataccccaacagagagagctcgggatcctctagatcacncagcac

SEQ ID NO: 733407 - DNA, 958 bp, Homo sapiens
  misc_feature (952)..(952): n is a, c, g, or t
tttttaattattattatactttaagttttagggtacatgtgcacaatgtgcaggtttgttacatatgtaggaactattgttcttaatacccattttatttcccaatctgcccctgacatccggcacaaacttaaaaaggctgaagatggctctcaaaccccacaacaagacctccttaacctggctttcaaagtctttaataacagggacgagcaaaataaattagataaagcccaaagagatcgtgctaaataccagcttccagcagtggctatctgtcagtctagccatagtacccaagggcacaaaagacctgatagcagcaaacctcctgggccttgttttaagtgcggcaaagaaggccactggacgggggcatgtccccacccatgagtgccgaagagcccttgcctagtctgccagcagatgggcactggaagtctgactgtcctctcaacagatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccaacagagagagctcgggatcctctagatcacncagcac

SEQ ID NO: 733408 - DNA, 945 bp, Homo sapiens
  misc_feature (939)..(939): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccagagtcccctcctgctcctctccgctagtccggcccctgacccctttccccagtacccacttcctgcctctctcattaacccttccgtagctgctcaccatgaccccatcagaatccagttaaaagactcttccaaatttcccagcgttcctcaataccccaacagagagagctcgggatcctctagatcacncagcac

SEQ ID NO: 733409 - DNA, 673 bp, Homo sapiens
  misc_feature (631)..(631): n is a, c, g, or t
  misc_feature (659)..(659): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtctnacgccatcactctggatttatcaggatnaaatgggaccggcc

SEQ ID NO: 733410 - DNA, 784 bp, Homo sapiens
  misc_feature (778)..(778): n is a, c, g, or t
gctgcctcctctgactgtggtggagcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagagggatgggcagacaagcatgctcctcagagccaccatcccttcaacaagacaaaaagtgaagaatcacttgcactcccatagctccttggcctagccactgaagactgatgaggccagggcccctgggccccggctcccggcccccactgccatcactgcatcggagcccagggtaactctactagtagcaggtaagctgatctcttttttaattgatagtggggccacctactcagctttgcctgagttctcaggacccactcatccctctcaagtctcagttgtgggggttgacggactcatctcttgtccgcttgccaccagacctcttacttgttccctgtttgatgccattttctcacactctttccttatcatgcctcattgccccacccccattctaggctgagaccttttagccaaagtcaaagcttctatcaccttttcttgcccccttcaaccaacagagagagctcgggatcctctagatcacncagcac

SEQ ID NO: 733411 - DNA, 531 bp, Homo sapiens
ctttgactgtgggagaaaagtcaccagtcacaaccaagatgctgccaaagtgcccacccagttccatggtcttggtaatatttgtggttagtatgacctacatatcgtcacagctgctttcagtggccgcgtagaaaagcaagcaagcagaaaggaaccttcctggctgcggagaagctgtggagtaggctggctgcaagcaaggcctttggagcagatggagctggttgcggctctagctgtgggactttgagcaagtcattggatttctctgatcctgtttcctcattcgtaaaatgggcatgaaaagagggagttaagtgaaatgtctgtctcatgctcagggctaacagcacacaacaaatgctcaattcatggtaaatggtaatattcttgttagtagagggcacaaacacttgtatatcagctcaggagtatgtcagtttcacattcattgacatttactgtttctactggttaaaaaaattaatgcatacttgtaaaaaagtttaaagttcagaagagaaaaaa

SEQ ID NO: 733412 - DNA, 458 bp, Homo sapiens; identical to SEQ ID NO: 420

SEQ ID NO: 733413 - DNA, 387 bp, Homo sapiens
agagctagcaccatgagcttcaataccctgtagactatcttatcgaaacccgtcatttacaaacgcagaaaaatgaggcccagagaagaagtggtccaaggacacacagctcacctggagcagagtcaggaccgtccccctctcacaaatcccaggaatctttccactactacactaagctgcttcaacctttgtgtgagtgccacagtcacctgagatgatggcaggaatgaatcagtgttggaaaccctatacaaagtgaatggagagcaacagaagagtcggcaacagaagggtccccagggcagtgtgctggtgcctgaaaaatcttaccactcaggaaagcagaagaatttttttcagcagaaggttcacctggagaattct

SEQ ID NO: 733414 - DNA, 660 bp, Homo sapiens
agaattctaccccaagggcaggagttgtgttcagcaggtgcttggtagatgtgtgttggatgttgagtggatgcgagaatcccttgcgtacaactgtctggtttctacaatctgacattgaatgcctgtcagcctcactgctctaagatggtcttaaatgcctcatttgagtacagtattctttcttatttttaagtgaatttgcagtgtgtgctttcatcaagacgttatgatgagtaatttcaaagcagcttcacaattgaagttagccttaatgtacccttttgatcagtgtcctgcctacctgaaagtactacatgtaccagtaggtacataatttttaattgatttaggtttaacttttaaaaacacgtgtaaattgctttttaaaaacttctgattttagataattatagattcatatgcagttgcaagaaataatagagacaccctttatacccttaacccagtcctctacccaaaccctcccatttggtaacatcttgaatgactagaccctatcacaaccggaaaaatgacactgatagttctacactcagttgtgtgtgtgtgtggttgttttttgaaagtttaatacatttaaaggatgattaaagtatttgaactcatgaaattctttaatatttgaggttttaaaaa

SEQ ID NO: 733415 - DNA, 265 bp, Homo sapiens; identical to SEQ ID NO: 453533

SEQ ID NO: 733416 - DNA, 756 bp, Homo sapiens
gttgcagattttttggactggagagagagatagtaatttaaaaaaaaaaagaaaagaaaactttcaaaatgttcttattgaaacctggcacccatttttcttaataggagcatccttagatgggtgagtataagaggaatgggagcttttatattgtttgttttcacatcattagcagcttaccttcttgtgaagataattaaatgccgtgctcctacggaagcactcatacataatgcagcaaggagagcgggagtcccactagcttcccaccagtttccccagttcagaagttatacacttgatattttccgctgttgacaagttttctggtttgcccacacggagttatctgtagaattatctgtattatgtttctaattaagtattgagaccctgaaattacattttgatttgttctttattgagccagaaggatctagtcagaacttctgagtgatggcagcagagactgtaaagccatttccagcattgtgcagaagtacaagctttagggtgtatctattcatctattcctagtacataaaatttagccttacaaaaagatgacattgttttatgtattttttaatgtgtgcctttaaaaagatttaaaaagtagagataatttaagggtgtttataaattatggggtgctgtctggagaaggacaaatcaataaatgcttattgaacacctattgatgttgatgacgtttgttatcttgtggggtggcagcatgctggtgtgttttgt

SEQ ID NO: 733417 - DNA, 948 bp, Homo sapiens
ttttatgtgtatataaatcttgtcttttattttttaagacaaccctgaagttttctgtggaaaccagaaagggcaagaaattggtcttaggttgctcaaggaaactggtactcacttgtaccctgcggctatacattatatacaggaaaaggaggagggatccaaggagggcgtggagctcctgtgcgtggtccattaattcacattttgctctcttcggttcacatcctgcgcggactccacccaaggcaaccgagcgagggggtgggtgggactcacagcctaccaaataacagtcccagaaaccgaaacgaaatcgaggtggaattctgaaaacacggctcaccagaaagaggggtggagaaggagcgcgagaggagacccttcttttggcagaagaggtatccctggccctcgttgcttcctgggctcccccccatcccctcaatcgcaaacagttccctcctttcctacgcatggaagaaggaagacacacacagagcaaggccactcatccttggaacgtgggcggagaacacacaagtattcctcagagaatttcaaaagaaatcggggaaaagcaacctgggagaggaggaggaaaggaaactgactgccaagtgggggacccgcgagacggtggaaaggaactaagcagatagcccctgggtgcctgcgccccaggaaagaagggctacctgttgaatggaactgttcctgcggaggcggagagggaagaaggcgagtcaccccagagagcggagccgttgtccctagagcagcctcgctggggctggtggcgagggatctcagccccagtgcctgcggagccccaccctgagaagccttggctgcagatacggtgatgagagacaccgacagaaacaagggagaggcgcacgactggagccggtctggcctgtcccgcggttagtcactcacatctga

SEQ ID NO: 733418 - DNA, 588 bp, Homo sapiens
attgtgcttacatccttaaatcgatccttacatccctgtgataattggcggagtttcagttgatctacttacaaagcccttggttgggatttttcatttccactcccattgtcttaagaatacaaaagaaatagggagctatcctaaagaaaattagcaatcagatgtggagccaaattatacagaaaaaaaaaattgtttagactagttaggaagtacactgtcaaggataaacttaataaagggctaatcagttgtatacattttgaaggaagaaagagaaacactggtgtggaagagaacatcctgggtggataagattatacttgcaaagggaagaatgcgaaagtcattctcaacagtccataagtggctcatctttttttttttgagactgagtcttgctctgtgtcccaggctggagtggcacaatctcggctcagtacaatctccacctcccaggtttaagcagctacttgggaggccaaggcagagaattgcttgaatctgggaggtggaggttgcagtgagccgagatcgtgccactgcactccagcctggatgacagaatgagattccatctcaaaa

SEQ ID NO: 733419 - DNA, 559 bp, Homo sapiens
ctaaagagccaagtctgggtgctgtcgtgagaaggaaacatgggtatggaagaggcacaacttgccgtctcaaggccctggtccaaaagtggcccatatcactcctgctcccagcccttagcagggacataggcacatggccataccccactgccagctgcaaagcaggctgggaacaaaatccttacaggcatttatgtgaccagcaatagctctgtgctatggagaaaagagaaaaggaattttgctgggacagctttcggtctctgctaaatttattgattgattttcaaattttttttagatatgaggtcttgctttgttgcccaggtaggtcttgaactcctgggctcaagcgattcccccaccttggcctcccaaagtgggattacaggcatgagctaccatgcccagctgctactaaatttattacccgtaaaataaaaataaaaataaatttaaaaaggaagttgagttttgattcgatgtcttcagagggcatttccttttggaattaatcatacagaagatgtatactctgaagcaatttgaagattta

SEQ ID NO: 733420 - DNA, 760 bp, Homo sapiens; identical to SEQ ID NO: 4991
  misc_feature (752)..(752): n is a, c, g, or t
  misc_feature (754)..(754): n is a, c, g, or t
  misc_feature (756)..(758): n is a, c, g, or t
  misc_feature (760)..(760): n is a, c, g, or t

SEQ ID NO: 733421 - DNA, 1044 bp, Homo sapiens; identical to SEQ ID NO: 4993
  misc_feature (1036)..(1036): n is a, c, g, or t
  misc_feature (1038)..(1038): n is a, c, g, or t
  misc_feature (1040)..(1042): n is a, c, g, or t
  misc_feature (1044)..(1044): n is a, c, g, or t

SEQ ID NO: 733422 - DNA, 607 bp, Homo sapiens
tgcatgatctaaggtagtggaaatggttgtggacaaactataaatgactaaactggatgattatctctcttggtctagtcattactgtggtgctagggttactttttacaatcttgttctaattttttttaacttcttgcatttcatcccagatcctggttcctatcctagttattaaggtaaaatagagaaccagaatagtttatcaggtatctgcattccttcaatatgaattataatggtacagatatggggataaaaggaatctttttctgctattaagtttatcagaaaagccccaatagttaaatatttgttttcagtagagggtataataagggaaaattatataacattatatgccaaataggaaactgatcttggttggaaataaagttgtaggaagaaaagctagccaattagtggctgagtagaggggactgcctgtcggtggggcttcatatcatcaacaagaagtgtgctagccttcttggctcctcatttcttttcttcctggaatccccagtactgcttttagccttctgtaaccactgccttcttggaggacctgcctcaggctatgatagcttgttacgtgacttagagc

SEQ ID NO: 733423 - DNA, 666 bp, Homo sapiens; identical to SEQ ID NO: 5046
  misc_feature (661)..(661): n is a, c, g, or t
  misc_feature (663)..(666): n is a, c, g, or t

SEQ ID NO: 733424 - DNA, 590 bp, Homo sapiens
cgagaaggggaagaattttatttatctgccactaatccccatgtgtctcatacccaaatctaggattttcctcttcccacctggagtatccggcgtgcatggtttatccacaattaaagcagactgcaggctgctcccctcaccagaaagccgctcccttaagcagccatagattacatgccctggctctgcctgccagagaaagccggtggatttgattttgttagcaagagctgactgagaccctagcagctgcattctactttacatattaaagagtggaaatacaaataggacagtccttttgccactgcaagagcagggggggttaggtgggtagaaaggcaggattttacttgtggaaatcagtgcctgccttccatccacaaaaaccagatgtcaatatggaggaggcacatgtcagcggcgcctgggaagcctgagttccagctttccctccccacaaccctgctctgtaactgtgggcagagcatgtctgctccaagagcctcagtttacacccctgaaaaatggagttaatgccttacagggattttatgagccacagtaagagattatgtgtgaaagaa

SEQ ID NO: 733425 - DNA, 821 bp, Homo sapiens
aaactacattttgcaaagtcattgaactctgagctcagttgcagtactcgggaagccatgcaggatgaagatggatacatcaccttaaatattaaaactcggaaaccagctctcgtctccgttggctctgcatcctcctcctggtggcgtgtgatggctttgattctgctgatcctgtgcgtggggatggttgtcgggctggtggctctggggatttggtctgtcatgcagcgcaattacctacaagatgagaatgaaaatcgcacaggaactctgcaacaattagcaaagcgcttctgtcaatatgtggtaaaacaatcagaactaaagggcactttcaaaggtcataaatgcagcccctgtgacacaaactggagatattatggagatagctgctatgggttcttcaggcacaacttaacatgggaagagagtaagcagtactgcactgacatgaatgctactctcctgaagattgacaaccggaacattgtggagtacatcaaagccaggactcatttaattcgttgggtcggattatctcgccagaagtcgaatgaggtctggaagtgggaggatggctcggttatctcagaaaatatgtttgagtttttggaagatggaaaaggaaatatgaattgtgcttattttcataatgggaaaatgcaccctaccttctgtgagaacaaacattatttaatgtgtgagaggaaggctggcatgaccaaggtggaccaactaccttaatgcaaagaggtggacaggataacacagataagggctttattgtacaataaaagatatgtatgaatgcataaaaa

SEQ ID NO: 733426 - DNA, 1080 bp, Homo sapiens
aaactacattttgcaaagtcattgaactctgagctcagttgcagtactcgggaagccatgcaggatgaagatggatacatcaccttaaatattaaaactcggaaaccagctctcgtctccgttggctctgcatcctcctcctggtggcgtgtgatggctttgattctgctgatcctgtgcgtggggatggttgtcgggctggtggctctggggatttggtctgtcatgcagcgcaattacctacaagatgagaatgaaaatcgcacaggaactctgcaacaattagcaaagcgcttctgtcaatatgtggtaaaacaatcagaactaaagggcactttcaaaggtcataaatgcagcccctgtgacacaaactggagatattatggagatagctgctatgggttcttcaggcacaacttaacatgggaagagagtaagcagtactgcactgacatgaatgctactctcctgaagattgacaaccggaacattgtggagtacatcaaagccaggactcatttaattcgttgggtcggattatctcgccagaagtcgaatgaggtctggaagtgggaggatggctcggttatctcagaaaatatgtttgagtttttggaagatggaaaaggaaatatgaattgtgcttattttcataatgggaaaatgcaccctaccttctgtgagaacaaacattatttaatgtgtgagaggaaggctggcatgaccaaggtggaccaactaccttaatgcaaagaggtggacaggataacacagataagggctttattgtacaataaaagatatgtatgaatgcataaaaagctgaaaattgcttatttctccctttcttctcactggagttatttttaatattatctttcctatcagaattacctagtcccttctttgaatatacagaagccatcacgtgagtttatcatttgcttcccaattgttctattttcctttaattttctttcttcttgtccttcatttctaattacctgaacatggtatgatttactgcatcttcagatatacacatataacatcaaaatcaggccaatataggttagggct

SEQ ID NO: 733427 - DNA, 322 bp, Homo sapiens
cctattttcctcagtctctatttggtgcatcaaactactatacgcagagtctgattactgattgtttgctcagttttcaaaggaatttattctaactttcccttcacaggtttgagtttttggaagatggaaaaggaaatatgaattgtgcttattttcataatgggaaaatgcaccctaccttctgtgagaacaaacattatttaatgtgtgagaggaaggctggcatgaccaaggtggaccaactaccttaatgcaaagaggtggacaggataacacagataagggctttattgtacaataaaagatatgtatgaatgca

SEQ ID NO: 733428 - DNA, 3649 bp, Homo sapiens
agggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaagcccctgagcctggctgcaggagtgaagctgctggagatcctggctgagcatgtgcacatgtcctcaggcagcttcatcaacatcagtgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggtctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaaaaaaa

SEQ ID NO: 733429 - DNA, 461 bp, Homo sapiens
ggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaagagtaagaggtggaaccctagagatgggctattcacatttggactctctggagaagcccagaggagccttctaagaagaagtcactggaaaaggccagcttccatcttcttaggaccagttcctctcactggcattgtctgagtgctacagagccaagaactctggaatcctcagccaggataatattccactcacccaattcctcattcaacaagtatttattgagtacttactatgtagcaggcatagttttaggtatttggaatgtatcgggaataaaacaaagatctctgct

SEQ ID NO: 733430 - DNA, 3562 bp, Homo sapiens
agggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaatgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggtctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaaaaaaa

SEQ ID NO: 733431 - DNA, 1884 bp, Homo sapiens
agggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaatgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctg

SEQ ID NO: 733432 - DNA, 1888 bp, Homo sapiens; identical to SEQ ID NO: 8972

SEQ ID NO: 733433 - DNA, 603 bp, Homo sapiens; identical to SEQ ID NO: 8957
  misc_feature (534)..(534): n is a, c, g, or t
  misc_feature (539)..(539): n is a, c, g, or t
  misc_feature (547)..(547): n is a, c, g, or t
  misc_feature (549)..(549): n is a, c, g, or t

SEQ ID NO: 733434 - DNA, 1299 bp, Homo sapiens; identical to SEQ ID NO: 10513

SEQ ID NO: 733435 - DNA, 1320 bp, Homo sapiens; identical to SEQ ID NO: 728836

SEQ ID NO: 733436 - DNA, 427 bp, Homo sapiens
ttgtctagtaattttgactccctccttatttagtagtgacaggatcctaagattaacaagagttttaaatttgtaaaacaatctgaagattgagggagctggctaggtgcattaaaatgtgtacttttcctagacctgatagggttacagcaacatgctcacgtagattgggacagagcctccttctgtttccctgtctagaatcccttgtaggctgtttgtggttgttgcaaaaacaatattgcccaaccatttcaagaacatcactgtaaactcttctggggcagttagtgaaaatgatgaatgaggtttctatggagtacccagcatcatgcttctctggattcttcttattccccagttgtgctcttctgagtgctaaggactttcatggaaaggagttttctgcttaatatgtttcaaagag

SEQ ID NO: 733437 - DNA, 657 bp, Homo sapiens
gacacaaagaaactttgtcaaaattggctgatatttgtacattttaatatatgtattttttcctgaagagctgtaaataataattgggaggggaacagggagcaggtagaggtatagaagagccaggaatagcagaatactggtaattattgaagattaataatgtttacatggtgacttgttgtagaattctgttcattttacttaagtttgaaattttctgtaataaaaatttgtaagaggttccaggggaataagcacagggagaaatgtttggatattgaacttggcattatatcatttgattgtcaactttaaaaataaaaggtaaaataaatataaagctttttaacttttttcccaaaaataattaagtaggggaaaggggggtattgaaaactggctgagagatttagagaactagaaataaaccacttgcctaaaacaaacgtaatagaaatagctaaattcaaaataattaatacggaattaattgcagcagttttcaaactgttaaatagcccagaaaaaaatggatagaggtttgtctcctaattgatttgaatccatagtttgggattttgtctacatctgattcttttaaaatgctttcttttttaaatttgctttccatatgaggattgatacaattgattc

SEQ ID NO: 733438 - DNA, 1009 bp, Homo sapiens; identical to SEQ ID NO: 214571

SEQ ID NO: 733439 - DNA, 633 bp, Homo sapiens
tgaaggcatgcagaaagcagtctggagcccagaagggacacaccagcacagtctggtaggctacagcagcaagtctctaaagaaaggctgagaacacccagaacaggagagttcaggtccaggatggccagcctgttccggtcctatctgccagcaatctggctgctgctgagccaactccttagagaaagcctagcagcagagctgaggggatgtggtccccgatttggaaaacacttgctgtcatattgccccatgcctgagaagacattcaccaccaccccaggagggtggctgctggaatctggacgtcccaaagaaatggtgtcaacctccaacaacaaagatggacaagccttaggtacgacatcagaattcattcctaatttgtcaccagagctgaagaaaccactgtctgaagggcagccatcattgaagaaaataatactttcccgcaaaaagagaagtggacgtcacagatttgatccattctgttgtgaagtaatttgtgacgatggaacttcagttaaattatgtacatagtagagtaatcatggactggacatctcatccattctcatatgtattctcaatgacaaattcactgatgcccaattaaatgattgctgttta

SEQ ID NO: 733440 - DNA, 434 bp, Homo sapiens; identical to SEQ ID NO: 214573
  misc_feature (352)..(352): n is a, c, g, or t
  misc_feature (421)..(421): n is a, c, g, or t
  misc_feature (426)..(426): n is a, c, g, or t

SEQ ID NO: 733441 - DNA, 443 bp, Homo sapiens
tggaagtgaaagtagcactttgaaaaagtattaagtaagttgcaaaccattctctataacctaaatgtcaccaaccaccagtcaggaagtttgtcctggtctatttcacttcctcacactggaggagaggtattggggtccccacaaagtattggaaaggcagcatgacttagaatgatgctcttaggactgagaaacaggagaccttggtatgagacttactttgcctccagtgagcaggggaaggtcacttcaccatctttatctaaaaaataaaggctttgggctctgatccacagagatgggtgagtcctaatgctctgtgactctatgcatctggtatccttttcctgtccagggctagaaatatattttgtcttttccagtcataagaaaagtgggaggagcctgggcaacataacaaaaccccatctctacaaaaa

SEQ ID NO: 733442 - DNA, 1718 bp, Homo sapiens
tgctgagtacctactgtatgtgagtcactgtgcaggcactagaaatataaagcaaaaaaaacagattctacccaccgggagctcctagtccagtggtgaagaggtgtattaaccctcaaggccctaagaaaatccccaatagggctctgcacaagccgggctctgataggaggtgccagtgcttttcttcttccagtttcagagccccagcgatcccagggatgaaggagagcccatttgcaaccctcttctgtctccctaagcattcaacaaacacttagtgaccatctgtcttgtgcaaaaagcttggggagtgataaaaacaaatcaaattcacattttaatttagggagtttaggagatacatcctagtgtggatttcacatggtcaatgatttgctttccttgaatttgccctctgcaaccaacacctgttcgtgctatgagactgaagtcctcctagaccgccccattcatctgagtagttagggctctggatgaaggagcaaatggacaaaataagccccctcttgctcaggacctgactaacatttcagaactgcggtcacccattttatacaaaccaaagcacttctgacagacctctgaatttgcattaaaaagagcacgtctacagctcctaacaatcaaaaacaactatgaacactgcttgcttcagtgatacaaacagacattttcttgttacatgtgtggtgatctgagaatggtgactttggacccagtttgactggttagcgtttaaataaaacttaacagactaggcaactaaaggaactcagtaaaagatcaaaagcaatgctcaaagggagtgcctgggtaaccatgatgtaattgcagattgacacatctttgggtttttcattattgtttctaaaaactagatattattgctttattattatgttgatgatgattattgaaagcacgatagcaatgtttaagtggtgagaatgactctaagcctcttttgttgctgtgactgacagaactaaagggagtttgctctcacattcacaataccaactctgccatcttatggaaaatattggaagtacctagggcatttcattatatttcaaaggcacaggttgctggtaagagggacagaaagacaagaacatagtaccttctatttctactacatgtttttaatctttaacatttttaccagcagaaatcattttttttttaaatctctcaatcttcaaataattcttagattgcttgccagcaaagatgtctcttgatcttgacactggaattcaatgtaaaaatcttgaatgatattttgtactgatatgaatttctactgtcccataacactgtgtagtgacttcactgtatattaacttcttttctacagatgtttgacttatgagatgaattaattgaaaaagtcaaagcctatcaggagctatcttatatgatgttggtagcctgtgaaaaaataaatgtcttttttcttatacaaactgataacaagacttgctttcacaattactatttacatttttgtgcatataatgcctgtatattatactcatatttgaaagtgatcagaaagtgttatttaacagaaactacatacattttttatgtctctctggaccctttgattctaagtaaatttacagtaagttagcagtaatagactattcttttcaactatgaataaaatgtacactgaagtacaagat

SEQ ID NO: 733443 - DNA, 396 bp, Homo sapiens
gcatcccaaggcacttgcccagagctgcagagttgtgtgtgccatacctgcggctcaaagggaaggccttctatcccctgagtttctatcagctgaaaatggcaactgctgtctcagtaaaagctctgtcttgactgcagaggctccaaaagcattcacagttgagggggagaaagacagaaagaagaagccaaagataacctgatccctgcctgtctgttggcacctgtcatcctctggcttctgctcccaaaagcaagtctggatgactgagttttgtggacatgggcactcccggagacagcagtggccaccatgggacccagagttttgcccaagtacttgaatgtttttgttgaggcaaccatgttttccccaagtaggtaggccagcgct

SEQ ID NO: 733444 - DNA, 782 bp, Homo sapiens
ttcaatcatgccatttaattttttaaatacgcaagtgtagttttataatttgtgtctgataattctaatatctgaagtcttagtaggtctgtttcagttgtcctgtaattatgcatgtttttgcccatgttgctttgtttccttgtatgcttggttatctttcttactgcccttgcaaaattatttggagagtcctgggaggcttaaatgaagataacttttaggaataatttgcatttgcttttgccgaggatcttgggatcatttcaaccaaaatcttagcttgaaattccgcaatcaatcaaggtgatgagaacctggtcagtaaatcctaatgagggccaggctgtggccaaagatttttagacagatgtttccctcctttgccatttctcttttctttcctcctctgctcctcttagtgtccagacaaccttcatggaagtccttggggtgggtgggaaatgaggacggcaggtttcattctaggtatagccctttgaggtctaacttaatgcagagagagttttctggtctatgtgccaccttacatgggatcttgagccttgatttctaaaccccttgcctttgatgtttcagaattgaagcttaaatttgccaacaggcaaatgtcctcaaggcaaattggcttaggtgttcgatattcttcttaccagaaaggtaaacttgggttttttacttcacccaggatttggcatgacagttccccattatttggtccgttaggggtaaggatgcgtttaacaattgcgttgtttcgg

SEQ ID NO: 733445 - DNA, 3215 bp, Homo sapiens; identical to SEQ ID NO: 23786

SEQ ID NO: 733446 - DNA, 1331 bp, Homo sapiens
  misc_feature (2)..(2): n is a, c, g, or t
anataaaagaaaagaagaggaaaagataactctgttataccaattactaggtatgtgaaagagaaaacaaccaacagtgtataagggcgacagaatcaaggctgggatatggaaggaggggaggaagagaggaagagagaacagaaaatatttttccaagttgtggttcttgatccaagatctgaaaatataaggtttaacttgccaaagtagggcaatggcttgccaatgggacaacggctgctttgtaaaaccatttgctctgagttcagataagtaaaaactatttctcctattttccttgactctctcatgcatgatctcgggttctctgtattttccagttttggatgtcaccacctatatcagttagagtccacctgctatagtaaacaaccgacacaattacagtgatttaaataagtaaactctatttctgtatgtaataatagtcctgttagttccagttatcaggcagctttgacccaggaagacattcacaaaatcagacaattttccttctgggttcctactattcaatagtttgtgcccttgtgtattcagtcaaaaataaactgcttccacatcttcattccaacccatgggagggggaaaaagactcacccatacaaaaaagcttaacttgaatcatccagaagtagcatccaatatctccactcacacacattgttccaaacatgaggtacatatgcacacctagccagaggaaagccagggacatacaggttttagctggatggtcaaatgtttagataaagatatatttatagggaataaaggaaatgaatttagggagaaaagcactacctgtctgatttctgatttcttcaagttaccttctgttcaagttggctttggctatgcagtcagtggtttgctttcattatgcatttcctgaccttagtcctatccctggttccatttttatcatcccattactatctttcatcctctcatgtatgcctttttctttattttctgattccactcccacctctcaacccaaaattttgctgtaacctctttcagcagtatattttggtacctggtacagtcaacgtgctgagtgttagggttccattaaaggaaaaatatacattttacataatttcataaagaaagatttcttacagttaagtaaattaaacaggatatcatgtacataatgcatttgatttagaagttgagttttatgatgtttagaaactgtaacaataaggataaaagataattctagaaaaattcatacattcaaaaaatactattgtaataaaagtataaaatttctataataaagagaaagtaatgca

SEQ ID NO: 733447 - DNA, 265 bp, Homo sapiens
tctaaaacttagtatagagaagcatggtggtgccacaatatgcgtatgcttagctaacaggagaaagagctctctgggtccctcattctgtccttctgtcctaaactaaaatgcagaaaaccctatcccgcacagtactaattttatgcagcttaatatcattattgatagtaatattacctttttcttttcagctcagtgtaaacaaggcacctactcatacagtggacttgagacttgtgaatcgtgtccactgggcacttat

SEQ ID NO: 733448 - DNA, 5156 bp, Homo sapiens; identical to SEQ ID NO: 426302
  misc_feature (4213)..(4213): n is a, c, g, or t

SEQ ID NO: 733449 - DNA, 2372 bp, Homo sapiens; identical to SEQ ID NO: 426303

SEQ ID NO: 733450 - DNA, 3242 bp, Homo sapiens; identical to SEQ ID NO: 426305

SEQ ID NO: 733451 - DNA, 2480 bp, Homo sapiens
agagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggaccaggtggctggggtgcagctaataggctggattactcttacgatgacttcctggacactgtgcaagaaacagccacaagcatcggcaatgccaagtcctcacggattaaaagaagtgccccattatctgactataaaattaagttaatttttaacatcacagctagtgtgccattacccgatgaaagaaatgatacccttgaatgggaaaatcagcaacgactccttcagacattggaaactatcacaaataaactgaaaaggactctcaacaaagaccccatgtattcctttcagcttgcatcagaaatacttatagccgacagcaattcattagaaacaaaaaaggcttcccccttctgcagaccaggctcagtgctgagagggcgtatgtgtggtaagactgttccctgtgatcaaaaatattt

SEQ ID NO: 733452 - DNA, 1457 bp, Homo sapiens
gcctgcattgtgaaacagaagtcaatgaatgccagtcaaacccatgcttaaataatgcagtctgtgaagaccaggttgggggattcttgtgcaaatgcccacctggatttttgggtacccgatgtggaaagaacgtcgatgagtgtctcagtcagccatgcaaaaatggagctacctgtaaagacggtgccaatagcttcagatgcctgtgtgcagctggcttcacaggatcacactgtgaattgaacatcaatgaatgtcagtctaatccatgtagaaatcaggccacctgtgtggatgaattaaattcatacagttgtaaatgtcagccaggattttcaggcaaaaggtgtgaaacagaacagtctacaggctttaacctggattttgaagtttctggcatctatggatatgtcatgctagatggcatgctcccatctctccatgctctaacctgtaccttctggatgaaatcctctgacgacatgaactatggaacaccaatctcctatgcagttgataacggcagcgacaataccttgctcctgactgattataacggctgggttctttatgtgaatggcagggaaaagataacaaactgtccctcggtgaatgatggcagatggcatcatattgcaatcacttggacaagtgccaatggcatctggaaagtctatatcgatgggaaattatctgacggtggtgctggcctctctgttggtttgcccatacctggtggtggtgcgttagttctggggcaagagcaagacaaaaaaggagagggattcagcccagctgagtcttttgtgggctccataagccagctcaacctctgggactatgtcctgtctccacagcaggtgaagtcactggctacctcctgcccagaggaactcagtaaaggaaacgtgttagcatggcctgatttcttgtcaggaattgtggggaaagtgaagatcgattctaagagcatattttgttctgattgcccacgcttaggagggtcagtgcctcatctgagaactgcatctgaagatttaaagccaggttccaaagtcaatctgttctgtgatccaggcttccagctggtcgggaaccctgtgcagtactgtctgaatcaaggacagtggacacaaccacttcctcactgtgaacgcattagctgtggggtgccacctcctttggagaatggcttccattcagccgatgacttctatgctggcagcacagtaacctaccagtgcaacaatggctactatctattgggtgactcaaggatgttctgtacagataatgggagctggaacggcgtttcaccatcctgccttgatgtcgatgagtgtgcagttggatcagattgtagtgagcatgcttcttgcctgaacgtagatggatcctacatatgttcatgtgtcccaccgtacacaggagatgggaaaaactgtgcaggtaac

SEQ ID NO: 733453 - DNA, 809 bp, Homo sapiens; identical to SEQ ID NO: 426307

SEQ ID NO: 733454 - DNA, 599 bp, Homo sapiens; identical to SEQ ID NO: 426308

SEQ ID NO: 733455 - DNA, 326 bp, Homo sapiens; identical to SEQ ID NO: 426309

SEQ ID NO: 733456 - DNA, 422 bp, Homo sapiens; identical to SEQ ID NO: 426310

SEQ ID NO: 733457 - DNA, 520 bp, Homo sapiens
atttcggcactaggggctagacctacagcatggacctatggcataggatttgggctttcccattcaaaggagatgtcacatcccaaatgactcatcttcttcagtacttcaaattcataatcatttcatgtcagtaaaaccaaccaagaattcccctgtgtcagtctcctgtcttctattcctgggagcttttagctctggtgttttttttgtttgtttttttttcctctttaaaacatctctaggctgggattacaggcgtgagctactgcgcctggccttcagtggcattctagaatgttctattgaagttactatgtcagtgcttggatttcttactgtcttccccattagaacgtagtatgtagtgaagaattaaagccaaacataaacatttctagttttgtttttgtttttttccaactttaattatataggctagctggaagagtgagttaatttaacttgttaatttctgaagtgagattgcaacaacccatgaaatgctcggggtttttct

SEQ ID NO: 733458 - DNA, 831 bp, Homo sapiens
gtagggacagggtctcattatgttgcccaggctggtctgaaactcctggcctcaagtgatccttctgcctcagcctcccaaagtgcggacattataggcatgagccacgggaccaggacagaaaacaattttaaaatgacaacctccctgtgaaataaaacttgactggcacctgggtttgtatgactgtaaggattaaaaatggtcaagacaccctataaatagattaaggttccaacctaagtagaaacaatctggaaaacagaagtgtgtaagtttggacctcaattctgaaaatatactttttaaaaaacccgattttccaactcccaaacagattttagaaaccttaagagtatttttatgctggcttccaaaggttaaaacaaaatacactcatttcacctaggaatactgtcaaaggcattataaatgccttaatattacctatatatttttttacaaaccattaagcagtaaccttcctaaaataaaagtatttccccccctataggttaaggtctccctaagtatcccttatagatcatcatttaagctgactattcattgagtgacataaactgaaagctgctagagtagaatgacatgagaaaggaaacacagctgtagatggaatggaagggacacctgtggagctccatcccatggatctcagtccaaatccaaacttcacagctgaggcccaggggaagggaagacaggttttccttactgaaaagacttcactttttcagtcacacaaacattttagaccacaatagatttaatagcataaatatattttatgaaggtaacccaatcgatcataaa

SEQ ID NO: 733459 - DNA, 1540 bp, Homo sapiens; identical to SEQ ID NO: 31524

SEQ ID NO: 733460 - DNA, 1517 bp, Homo sapiens; identical to SEQ ID NO: 31525

SEQ ID NO: 733461 - DNA, 458 bp, Homo sapiens
  misc_feature (351)..(351): n is a, c, g, or t
  misc_feature (392)..(392): n is a, c, g, or t
  misc_feature (409)..(409): n is a, c, g, or t
  misc_feature (437)..(437): n is a, c, g, or t
  misc_feature (449)..(449): n is a, c, g, or t
ggaaccttagtgtgacatacacacagacacacagacgtgcacacacacacacacacacacaaaatttgtcataggttcccagttaataaatctattattgtttaatgtctttctttgtctctttgcagttttgacttaaagtactttatgtaagatatgacagtttttgacttaagatgtagcttttgtaatactattttgacctcttctgctctcatttggttaatatttgcatgcaatgtctaaatctatcttgccaccttcagtatgtttttaatcattaggatgtcagctgacccttgtaggaaagggcaaattgggatcttggggtttttaattaattttaaaatnaaatttctttattggaaagtatgtcctcttggatggggaangttttctggaaaccaanggggacttaccaattttttttgttgttnccatttggatcntggcatctt

SEQ ID NO: 733462 - DNA, 725 bp, Homo sapiens
agcggagcgggcgagcaagggagcgagcaggacaggagcctgatcccacagcagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaacagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgccccactaaaatttgggaagttatgcttatacatgagcagaagttgttacatgaatggaccagagaagcagtagctcagggtgtagcacaagatggatccgtctaaacagtatgac

SEQ ID NO: 733463 - DNA, 757 bp, Homo sapiens
ctcccgctggctccagtctctccacgattctctctcccagacttttccccgggcttaagagatcctgtgtccagagggggccttagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaacagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgccccactaaaatttgggaagttatgcttatacatgagcagaagttgttacatgaatggaccagagaagcagtagctcagggtgtagcacaagatggatccgtctaaacagtatgac

SEQ ID NO: 733464 - DNA, 814 bp, Homo sapiens
ggaaggcacgctcttgtcctggctgcaaaattgcctgtttttccctttccagtggacgctggtgaaatgccctcttgtgtaggggtctctcccattctgaacacgaaaactcaacttagtctttgatatggatggcatgggagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaacagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgccccactaaaatttgggaagttatgcttatacatgagcagaagttgttacatgaatggaccagagaagcagtagctcagggtgtagcacaagatggatccgtctaaacagtatgac

SEQ ID NO: 733465 - DNA, 1555 bp, Homo sapiens; identical to SEQ ID NO: 29525
  misc_feature (1551)..(1551): n is a, c, g, or t

SEQ ID NO: 733466 - DNA, 607 bp, Homo sapiens
  misc_feature (603)..(603): n is a, c, g, or t
ttcctggtcctacagagggtttagcacagaggagaagctgggcggggtgtttgttgctgtccttgcggctcttaaggatcgggggtggatggaagacttctgctgctcccgccccactcagcccctctgtctgcccgcagctcagagcccgactgtggccgagacactgcatcctgccttctccggagtccagcagtacacagccatgtaccccaccgcggccatcacgcccatcgcgcacagcgtcccccagccgccgcccctcctgcagcagcagcagcgagaaggagtttggagacacggagctgacgcagatgttcctacccttcggcaatatcatttcctccaaggtgtttatggatcgagctaccaaccagagcaagtgtttcggcttcgtgagctttgataacccggccagcgcccaggcagccatccaggccatgaacggcttccagatcggcatgaagaggctcaaagtccagctgaagcggcccaaagacccgtgaagggggtttctcccctgtcctccatcccccgtttctgttcattcacagctgcgtccccgagcactggaaacaggcctagcacataatagatgctcanacta

SEQ ID NO: 733467 - DNA, 308 bp, Homo sapiens; identical to SEQ ID NO: 29528

SEQ ID NO: 733468 - DNA, 621 bp, Homo sapiens
  misc_feature (52)..(52): n is a, c, g, or t
  misc_feature (70)..(70): n is a, c, g, or t
  misc_feature (126)..(126): n is a, c, g, or t
  misc_feature (188)..(188): n is a, c, g, or t
cggcacgagcacagaatgctggagagatgcgtcctggtgaacgtggggcagnccctcccacgacccccancagactgccttaggttttgtcagaccccactccctttccttccccctctgcctccnacccactctgggggtccacatcaagatagctgggcccagtgtggaagcccagcgtgtctgtnctagcagaaaggacacaagcctggtgttctggagacctcggctcaagtctttgccctgctgccgacgcattgtgtcaccttgggcaaggacttcgcatctccaggcctcagtttccccattagttaacatgacagcataacactagagagcagagggcccatttcagctctgttgttctgggattcaggctggccggtgctgtgtcctggagctttatttggggagtttcacccagaatggtgggagaaacctcccaggtgccaggtaccccgcatcgtgacccttcacttggtgtcttaggaagtcaagctgagggatgctgagtcctcccctggtggcccctgcagccccagccctgcttttcatccccagcgctgaaacatggaaggagccccctccttctcacctcggtctcctacccctgaatggaaa

SEQ ID NO: 733469 - DNA, 832 bp, Homo sapiens
taatttttaaaggcaatttagtatacatgatgagctagctttgaaatacagatttaaatgtttaaaaattaatttgagggcaagatttggtaccaaagtttcaaaaattttatttcactgcttataaaatactttatcagaacacttattttaaaaaataacatcttatttgaaaaactccaaatttgatggggatagttacaccatcatacaattttaaaggtagaattagctttctaatactttaaaatattttctgaaatgaacatttcacttggtttaggaccgtgtctgtaagtaaaagacaccaatgctaatagatatgacttacaaaaatgccacatatcgaaattgattgaggattgaaatatatatactttggcattgagaagagaggaagagaaaaaaataaaaaaagtgtgacattgtaatatttattgtatttaataaatcttgaagaaagaactcttgagcaatgaaccagtgacaggatataaaagcctgttttatttgatgacatcattaactgagttttctcatctatacattcatacatcgagaaggaactgtccttaaaaaccagtgtttctttttttttttaagttctagcgtacatgtgcagaatgtgcaggtttgttatataggtatacacgtgccatggtggtttgctgcacccatcaacctgtcatctacattaggtatttctcctaatgctatccctccccagtgatatttgttaatatgcttttttaaaaaagtgtctgccttgaaactggtaattaaaaaatatctcctagggcatttaattatttttcccaataaacaactcata

SEQ ID NO: 733470 - DNA, 458 bp, Homo sapiens
  misc_feature (13)..(13): n is a, c, g, or t
cacaagcctctgntggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgtcctgatttctgccccttgttcccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataa

SEQ ID NO: 733471 - DNA, 849 bp, Homo sapiens
cctcagaaaccaaccctggcatatatggtccgatgatcttccagaaggatgccaagaccactcaatggcaaagcacagtttcttcaacaaatggtgatgggaaaattgtataactacatgcaaaacaatgaagttggactcttaccttacaccacgttaaaatcaattcaaagtgaattataaacctaaatgtaaaactagaactatcaaactcctagggaaaacaaatttggaaaatgctttatgacgatgaatttgtcaataatttttaggatatgacattaaaagctcaggcagtaaaagcaaaaatatatcaaacctaaaaacttctgtacctcaaaggtcacaaccaacagggtaaaaggcaaactgtaaaattaaaaaaaataccagtttagtgtcccttatttgaaatgcttgggatgtgtttcagattttgtaatatttgcattattcttactggttgaggatctcaaattcaaacacctgagtctgagatgctccaataagcatttcctttgagtgtcatgttggcacttcaaaaagtttcagactttggaggcatttgggatttcagatttttgggatcagagacattcaaccctatagttgcacatcatgtatctcataagaagtgaacattcagaatgcgtaaagaactcctacagagagactaccagaagcagagaggagcaaacacattttcacactagggaacctgctatctctcctggattccaattagggcagagtaagtgctagttctctgccaaccaggattaggccctgcagctgcagtgaaaataatcacagaagaaaactaagaaataaaaaatggagaaagtgaga

SEQ ID NO: 733472 - DNA, 2667 bp, Homo sapiens
gctcccggggccacgggatgacgcctcctccgcccggacgtgccgcccccagcgcaccgcgcgcccgcgtccctggcccgccggctcggttggggcttccgctgcggctgcggctgctgctgctgctctgggcggccgccgcctccgcccagggccacctaaggagcggaccccgcatcttcgccgtctggaaaggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggtgaatatcggctccacaaaggggtcctgtctggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggctatccgacgacaggatccgagcttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccagacaaggccccactgcagaaggtttccctggccccaaactctcgctactacctgagctgccccatggaatcccgccacgccacctactcatggcgccacaaggagaacgtggagcagagctgcgaacctggtcaccagagccccaactgcatcctgttcatcgagaacctcacggcgcagcagtacggccactacttctgcgaggcccaggagggctcctacttccgcgaggctcagcactggcagctgctgcccgaggacggcatcatggccgagcacctgctgggtcatgcctgtgccctggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtggcgcacggatggtgaggggctgagaatgagggcaccgactgtgaagctggggcatcgatgacccaagactttatcttctggaaaatatttttcagactcctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcatctgta

SEQ ID NO: 733473 - DNA, 2323 bp, Homo sapiens
ttctgctggtcgattctagaggtatccctgtcgtcggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggctatccgacgacaggatccgagcttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccagacaaggccccactgcagaaggtttccctggccccaaactctcgctactacctgagctgccccatggaatcccgccacgccacctactcatggcgccacaaggagaacgtggagcagagctgcgaacctggtcaccagagccccaactgcatcctgttcatcgagaacctcacggcgcagcagtacggccactacttctgcgaggcccaggagggctcctacttccgcgaggctcagcactggcagctgctgcccgaggacggcatcatggccgagcacctgctgggtcatgcctgtgccctggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtggcgcacggatggtgaggggctgagaatgagggcaccgactgtgaagctggggcatcgatgacccaagactttatcttctggaaaatatttttcagactcctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcatctgta

SEQ ID NO: 733474 - DNA, 1110 bp, Homo sapiens
ttctgctggtcgattctagaggtatccctgtcgtcggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggctatccgacgacaggatccgagcttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccaaaaaa

SEQ ID NO: 733475 - DNA, 1621 bp, Homo sapiens
ttctgctggtcgattctagaggtatccctgtcgtcggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggctatccgacgacaggatccgagcttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccaggtacctgatctggccctgctggcggctgtggcccaatgagtggggtactgccctgccctgattgtcctggtctgagggagacatggccttgtcctgtgggccccaggtacatggggcaggatacagtcctgcagagggagccctcttggtgggatgagcgagacgggagaaaaaaggaggacgctgagggctgggttccccacgttcattcagaagccttgtcctgggatcccagtccgtggggaggacacatcctcccctgggagctctttgtccctcctcacggctgcttccccactgcctccccag

SEQ ID NO: 733476 - DNA, 1454 bp, Homo sapiens
gctcccggggccacgggatgacgcctcctccgcccggacgtgccgcccccagcgcaccgcgcgcccgcgtccctggcccgccggctcggttggggcttccgctgcggctgcggctgctgctgctgctctgggcggccgccgcctccgcccagggccacctaaggagcggaccccgcatcttcgccgtctggaaaggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggtgaatatcggctccacaaaggggtcctgtctggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggctatccgacgacaggatccgagcttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccaaaaaa

SEQ ID NO: 733477 - DNA, 1965 bp, Homo sapiens
gctcccggggccacgggatgacgcctcctccgcccggacgtgccgcccccagcgcaccgcgcgcccgcgtccctggcccgccggctcggttggggcttccgctgcggctgcggctgctgctgctgctctgggcggccgccgcctccgcccagggccacctaaggagcggaccccgcatcttcgccgtctggaaaggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggtgaatatcggctccacaaaggggtcctgtctggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggctatccgacgacaggatccgagcttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccaggtacctgatctggccctgctggcggctgtggcccaatgagtggggtactgccctgccctgattgtcctggtctgagggagacatggccttgtcctgtgggccccaggtacatggggcaggatacagtcctgcagagggagccctcttggtgggatgagcgagacgggagaaaaaaggaggacgctgagggctgggttccccacgttcattcagaagccttgtcctgggatcccagtccgtggggaggacacatcctcccctgggagctctttgtccctcctcacggctgcttccccactgcctccccag

SEQ ID NO: 733478 - DNA, 724 bp, Homo sapiens
gctcccggggccacgggatgacgcctcctccgcccggacgtgccgcccccagcgcaccgcgcgcccgcgtccctggcccgccggctcggttggggcttccgctgcggctgcggctgctgctgctgctctgggcggccgccgcctccgcccagggccacctaaggagcggaccccgcatcttcgccgtctggaaaggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggtgaatatcggctccacaaaggggtcctgtctggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaaccaccatcgccaggctttcccaggtcact

SEQ ID NO: 733479 - DNA, 773 bp, Homo sapiens
aaactaagataaaaataaacagataggagagctgaattccatttcaagtcctcatgtatatgcttacaaagttccaaattaagcttgggactggttcttacatggcaggtaatccaaaccttttctatttactgaagattttcagctctcttacagaaatacacaggctaccattaaaattgtagggataaattttaaattgaatttgaaaataagagcagtaatccagggaggaaatggctaaggagaatgaaatagaagacacaaaaacaagcaatgggcaaccagaagggaatcacttaattatggtatatatatttttccagttgtaaagctttgggttcaggggttcatcagatcctcttaagatagaatcagaattgtaattgtgcctgaagaatggtagtggagtttaaaaaaataaggaccttaagacagtgttacctggtgtgtagaaaggacacagttttgaaagaaattgtttttgctttgcaaatttccccccccgcttggaaaactgtattcaaggccacctatatatggcaattaaggccctgactttgtagttatttcgtgtgtttttatttgattgaaactgatgaaagaaacaagatgcccgtactttttaaacagtatttttaaaataaaacattctgaggaaattgagggatcaggagagaggagcacagactaatagaagggctatgcaaaaactagacatgtaatgatacattcttgtttgattacttctcttcgtttctgtattgtgattt

SEQ ID NO: 733480 - DNA, 868 bp, Homo sapiens
  misc_feature (656)..(656): n is a, c, g, or t
agacaagaagatcttgcactcttgcccaggctggagtgcagtggtgcgatcacagttcactgcatcctcgaactcctgggctcaagggattctcctgcctcagcatcccgagtagctgggactacaggcatgcaccaccacacctggctaattttttaaattaatttttttgtaaagaccagggctcaccatcttgcccgggctggtcttgaactccagggttcaagcaatcctcctgcctcagcctcccaaaatgttggtattacatatgtgagccactgtgcctggcctccgttaaattttctaattggttgttgctgattaaaaagacggctaatgatcttttatgttgattcttgattaactaaaattatttctgatagtttttcaccagcttctcttaagagtttctaaaaatacaaatagctgttaataacagtttggtttcctcctttctcatatgtatttatttatttacttttttttttttttttttgagacaaggtctcactctgttgcccaggctgggagtgcagtgggcatgattgtggctcactggcagccttgacctccccaggctcaagcaatcctcccacctcagccttctgagtagctgggactacaggtgcccgccaccatgcccaactactttgtanttttttgtagagatgggttttcgccatgttggccaggctggtctcgaactcctggcctcaagtaatctgcctgcctcagcctcccacagtgttgggattacaggcgtgagccaccgcacctgggctcctttcccatatttatacccttaaatttttttctggccttactgcatagctagatctctaagacaataaatattagctatgataac

SEQ ID NO: 733481 - DNA, 737 bp, Homo sapiens
ttaatctgactgcacttaagaatcatctgaagtgtttgtattggttagtcttatttttaatactgatgtcctggtctctctcccctcaaaaaaactctgctgctgggaccaagcacatagatgctttttaaaaagctcccgaaaatgactctaatatgcagccaggattgaaaataactaccctacacagcatttttcctgattctgagcactcagcttttcattgattttccctagggcaagtccttcatcttattctgggtccttgtgttttctttctgaacctacaatttctccataggtcccatggttttcaaaatttctcattttccattttctgtccttttatattacctacttgaaaaccacagtcatctttcaaaacaaaacactgcctgtttcttaggtctttattgtgggcttgttattcctcaatacaaatttacataaaataataacaattaagacatgggccttggtgtcagaattattttatatctttcttattaactctgcagcttaccagctctggataagttaaaggacagctatagtcttactacatagaatcattataaggaattggtggagtgatccttataaagtgtttgcatggtacctagcacagagaaagtgcttgaagttgttaactgttatggttacaaaatatgtaaataatttttattgtccaattttctctcttcatatacactaaattgttctaattcttgaaccac

SEQ ID NO: 733482 - DNA, 4220 bp, Homo sapiens
ctgatggatttgcattcaggttccagccctgcgtttcctatattgactccttatacacgacctggcgctccagtttaggaggagacgttgttttgtaatcaaccacgaacgatgaaaccttccatagctgagatgcttcacagaggaaggatgttgtggataattcttctaagcacaattgctctaggatggactaccccgattcccctaatagaggactcagaggaaatagatgagccctgttttgatccatgctactgtgaagttaaagaaagcctctttcatatacattgtgacagtaaaggatttacaaatattagtcagattaccgagttctggtcaagaccttttaaactgtatctgcagaggaattctatgaggaaattatataccaacagttttcttcatttgaataatgctgtgtctattaatcttgggaacaatgcattgcaggacattcagactggagctttcaatggtcttaagattttaaagagactatatctacatgaaaacaaactagatgtcttcagaaatgacaccttccttggcttggaaagtctagaatatctgcaggcagattacaatgtcattaaacgtattgagagtggggcatttcggaacctaagtaaattgagggttctgattttaaatgataatctcatccccatgcttccaaccaatttatttaaggctgtctctttaacccatttggacctacgtggaaataggttaaaggttcttttttaccgaggaatgctagatcacattggcagaagcctgatggagctccagctggaagaaaacccttggaactgtacatgtgaaattgtacaactgaagagttggctggaacgcattccttatactgccctggtgggagacattacctgtgagacccctttccacttccatggaaaggacctacgagaaatcaggaagacagaactctgtcccttgttgtctgactctgaggtagaggctagtttgggaattccacattcgtcatcaagtaaggagaatgcatggccaactaagccttcctcaatgctatcctctgttcattttactgcttcttctgtcgaatacaagtcctcaaataaacagcctaagcccaccaaacagcctcgaacaccaaggccaccctccacctcccaagctttatatcctggtccaaaccagcctcccattgctccttatcagaccagaccaccaatccccattatatgccccactgggtgtacctgtaatttgcacatcaatgaccttggcttgactgtcaactgcaaagagcgaggatttaataacatttctgaacttcttccaaggcccttgaatgccaagaaactgtatctgagtagcaatctgattcagaaaatataccgttctgatttttggaatttttcttccttggatctcttgcatctggggaacaatcgtatttcctatgtccaagatggggcctttatcaacttgcccaacttaaagagcctcttccttaatggcaacgatatagagaagctgacaccaggcatgttccgaggcctacagagtttgcactacttgtactttgagttcaatgtcatccgggaaatccagcctgcagccttcagcctcatgcccaacttgaagctgctattcctcaataataacttactgaggactctgccaacagacgcctttgctggcacatccctggcccggctcaacctgaggaagaactacttcctctatcttcccgtggctggtgtcctggaacacttgaatgccattgtccagatagacctcaatgagaatccttgggactgcacctgtgacctggtcccctttaaacagtggatcgaaaccatcagctcagtcagtgtggttggtgatgtgctttgcaggagccctgagaacctcacgcaccgtgatgtgcgcactattgagctggaagttctttgcccagagatgctgcacgttgcaccagctggagaatccccagcccagcctggagattctcaccttattggggcaccaaccagtgcatcaccttatgagttttctcctcctgggggccctgtgccactttctgtgttaattctcagcctgctggttctgtttttctcagcagtctttgttgctgcaggcctctttgcctacgtgctccgaaggcgtcgaaagaagctgcccttcagaagcaagcggcaggaaggtgtggaccttactggcatccaaatgcaatgccacaggctgtttgaggatggtggaggtggtggtggcggaagtgggggtggtggtcgaccaactctttcctctccagagaaggcccctcccgtgggtcatgtgtatgagtacatcccccacccggttacccaaatgtgcaacaaccccatctacaagcctcgtgaggaggaggaggtggctgtttcatcagcccaagaagcagggagtgcagaacgtgggggtccagggacacaaccaccgggaatgggtgaggctctcctaggaagtgagcagtttgctgagacacccaaggagaaccatagtaactaccggaccttgctggaaaaagagaaggagtgggccctagcagtgtccagctcccagcttaacaccatagtgacggtgaatcaccatcaccctcaccacccagcagttggtggggtttcaggagtagttgggggaactgggggagacttggcagggttccgccaccatgagaaaaatggtggggtggtgctgtttcctcctgggggaggctgtggtagtggcagtatgctactagatcgagagaggccacagcctgccccctgcacagtgggatttgtggactgtctctatggaacagtgcccaaattaaaggaactgcacgtgcaccctcctggcatgcaatacccagacttacagcaggatgccaggctcaaagaaacccttctcttctcggctggaaagggcttcacagaccaccaaacccaaaaaagtgattacctcgagttaagggccaaacttcaaaccaagccggattacctcgaagtcctggagaagacaacatacaggttctaacagagagaagaaaatatattagtgctttttttttttcaaaagaaaaggaaaataaaagaaatatatcccttgctccctttacacttgtcccagtaactccatcctcacgatctttcctaccctgaacaaaactaaaaccgcatgataactagagaatacagatgtatgctctcccctctcagatgcgatttggaggaagggccatactcagatcattaatcaatgaaagtgccttcgcagacttttgccagcaaatgttatcattatttttttatactgaaacttgagactttgactgtgccatgtataagatatactggggatcattgtatggatcctaattaagtaaaattcaatgtgtctttttattttcagtaactattttttttatagttgtagttttgatttaaagggggggaaacaagttgacatttgtcatttgtggctttctttcttatcatcatggcacagattctgtacatgtattaacaatgcagtttgctgcatgcctggaaactgcaagatggggagggagggggcgggtcttgctcgaatgttctcactcactatcttgtctctcatacacatatccatctgcagaccatggtccctaaacctgcagtttcttcctgctggtgcaggtacacacacacacacacacacacacacacacacacacacacactccataccatttccattcaactcaatctgcttagttcgggtttgatccatttttctcctctccatagttctaccacccttcactgctagtgtacagctcacagcatctctcctaccaccctgggaaaagtcacattctaggctggattctactgaagtagaggcctggtggtttaacagccgaagacacacgcctagggatgagcaccctctttgtgacacttcatcctgatgccaagattttttggagaacatctgcactttcttatatatatatataatattaaaaaaagcaactgggtatatatcactaacagctttgtaggaagcacttttaatgttttctctctcacacacaaagattcaaaagaaatgtgcatatatttattctgtaatttcagtgattataaattgtaaaggtaatgtttaatcattgtatagtgattatgcctctggtatagctttcctaataaaaagtttttgaaaaacat

SEQ ID NO: 733483 - DNA, 4769 bp, Homo sapiens
ttttgtaatcaaccacgaacgatgaaaccttccatagctgagatgcttcacagaggaaggatgttgtggataattcttctaagcacaattgctctaggatggactaccccgattcccctaatagaggactcagaggaaatagatgagccctgttttgatccatgctactgtgaagttaaagaaagcctctttcatatacattgtgacagtaaaggatttacaaatattagtcagattaccgagttctggtcaagaccttttaaactgtatctgcagaggaattctatgaggaaattatataccaacagttttcttcatttgaataatgctgtgtctattaatcttgggaacaatgcattgcaggacattcagactggagctttcaatggtcttaagattttaaagagactatatctacatgaaaacaaactagatgtcttcagaaatgacaccttccttggcttggaaagtctagaatatctgcaggcagattacaatgtcattaaacgtattgagagtggggcatttcggaacctaagtaaattgagggttctgattttaaatgataatctcatccccatgcttccaaccaatttatttaaggctgtctctttaacccatttggacctacgtggaaataggttaaaggttcttttttaccgaggaatgctagatcacattggcagaagcctgatggagctccagctggaagaaaacccttggaactgtacatgtgaaattgtacaactgaagagttggctggaacgcattccttatactgccctggtgggagacattacctgtgagacccctttccacttccatggaaaggacctacgagaaatcaggaagacagaactctgtcccttgttgtctgactctgaggtagaggctagtttgggaattccacattcgtcatcaagtaaggagaatgcatggccaactaagccttcctcaatgctatcctctgttcattttactgcttcttctgtcgaatacaagtcctcaaataaacagcctaagcccaccaaacagcctcgaacaccaaggccaccctccacctcccaagctttatatcctggtccaaaccagcctcccattgctccttatcagaccagaccaccaatccccattatatgccccactgggtgtacctgtaatttgcacatcaatgaccttggcttgactgtcaactgcaaagagcgaggatttaataacatttctgaacttcttccaaggcccttgaatgccaagaaactgtatctgagtagcaatctgattcagaaaatataccgttctgatttttggaatttttcttccttggatctcttgcatctggggaacaatcgtatttcctatgtccaagatggggcctttatcaacttgcccaacttaaagagcctcttccttaatggcaacgatatagagaagctgacaccaggcatgttccgaggcctacagagtttgcactacttgtactttgagttcaatgtcatccgggaaatccagcctgcagccttcagcctcatgcccaacttgaagctgctattcctcaataataacttactgaggactctgccaacagacgcctttgctggcacatccctggcccggctcaacctgaggaagaactacttcctctatcttcccgtggctggtgtcctggaacacttgaatgccattgtccagatagacctcaatgagaatccttgggactgcacctgtgacctggtcccctttaaacagtggatcgaaaccatcagctcagtcagtgtggttggtgatgtgctttgcaggagccctgagaacctcacgcaccgtgatgtgcgcactattgagctggaagttctttgcccagagatgctgcacgttgcaccagctggagaatccccagcccagcctggagattctcaccttattggggcaccaaccagtgcatcaccttatgagttttctcctcctgggggccctgtgccactttctgtgttaattctcagcctgctggttctgtttttctcagcagtctttgttgctgcaggcctctttgcctacgtgctccgaaggcgtcgaaagaagctgcccttcagaagcaagcggcaggaaggtgtggaccttactggcatccaaatgcaatgccacaggctgtttgaggatggtggaggtggtggtggcggaagtgggggtggtggtcgaccaactctttcctctccagagaaggcccctcccgtgggtcatgtgtatgagtacatcccccacccggttacccaaatgtgcaacaaccccatctacaagcctcgtgaggaggaggaggtggctgtttcatcagcccaagaagcagggagtgcagaacgtgggggtccagggacacaaccaccgggaatgggtgaggctctcctaggaagtgagcagtttgctgagacacccaaggagaaccatagtaactaccggaccttgctggaaaaagagaaggagtgggccctagcagtgtccagctcccagcttaacaccatagtgacggtgaatcaccatcaccctcaccacccagcagttggtggggtttcaggagtagttgggggaactgggggagacttggcagggttccgccaccatgagaaaaatggtggggtggtgctgtttcctcctgggggaggctgtggtagtggcagtatgctactagatcgagagaggccacagcctgccccctgcacagtgggatttgtggactgtctctatggaacagtgcccaaattaaaggaactgcacgtgcaccctcctggcatgcaatacccagacttacagcaggatgccaggctcaaagaaacccttctcttctcggctggaaagggcttcacagaccaccaaacccaaaaaagtgattacctcgagttaagggccaaacttcaaaccaagccggattacctcgaagtcctggagaagacaacatacaggttctaacagagagaagaaaatatattagtgctttttttttttcaaaagaaaaggaaaataaaagaaatatatcccttgctccctttacacttgtcccagtaactccatcctcacgatctttcctaccctgaacaaaactaaaaccgcatgataactagagaatacagatgtatgctctcccctctcagatgcgatttggaggaagggccatactcagatcattaatcaatgaaagtgccttcgcagacttttgccagcaaatgttatcattatttttttatactgaaacttgagactttgactgtgccatgtataagatatactggggatcattgtatggatcctaattaagtaaaattcaatgtgtctttttattttcagtaactattttttttatagttgtagttttgatttaaagggggggaaacaagttgacatttgtcatttgtggctttctttcttatcatcatggcacagattctgtacatgtattaacaatgcagtttgctgcatgcctggaaactgcaagatggggagggagggggcgggtcttgctcgaatgttctcactcactatcttgtctctcatacacatatccatctgcagaccatggtccctaaacctgcagtttcttcctgctggtgcaggtacacacacacacacacacacacacacacacacacacacacactccataccatttccattcaactcaatctgcttagttcgggtttgatccatttttctcctctccatagttctaccacccttcactgctagtgtacagctcacagcatctctcctaccaccctgggaaaagtcacattctaggctggattctactgaagtagaggcctggtggtttaacagccgaagacacacgcctagggatgagcaccctctttgtgacacttcatcctgatgccaagattttttggagaacatctgcactttcttatatatatatataatattaaaaaaagcaactgggtatatatcactaacagctttgtaggaagcacttttaatgttttctctctcacacacaaagattcaaaagaaatgtgcatatatttattctgtaatttcagtgattataaattgtaaaggtaatgtttaatcattgtatagtgattatgcctctggtatagctttcctaataaaaagtttttgaaaaacataatacattatatatagaggatacaaagcttgaaccttaaactccagctatgccatgcctttcgtgcttccattttagaaatgatttcttttacttgttacacagaaagtaatttattaacgggtttgatgcactgtgatgttgataaatcttatatcccaccatctctagtccaaaccaggatacaattgagacttaaaatgtgacttacggtttacttttttttccttgaattatgaatttcagtcttagtaaccagtgatgcactgtttcccaggcaagatgcaagggggagaaaataaagtaactagatcgctaagaagtacaggattaattaggagaagataatctaggatccatacatcttaagataataaatgagataaagaaattggaaagtaaaattgctattgtttttaaaatatgtagtccaattacatgcacaccctcacacacccacacgcttccacacacacccacacaacccaataaatatcaaaggccgtggagccaatttagatggccagaatcctgtgaaagctgtcacttatatttggttaccattttccaaccacttacagcaactggccccaataacgcttgaactaagtcagaggatgctgaatgagtttttcgtcat

SEQ ID NO: 733484 - DNA, 450 bp, Homo sapiens
ggattatttcaatatttttgtaataaaaaatatagggtatacacataggcatcatcacattttttatagaccctggaatcgtttaaaatactttaagcatcataattacttgggatgtcagaaactggtcccacaaattccatcagcctgcctcagcagattgaaaacatttgtctcttgcaagatcaccctactttgcaagttggtgcccccaggaaccctggcccaggggtgctatcagaatatcaggtgaagagagaatcagcttaaatagaaagggcttgtcaagactggccaatgtttcccaggaaatcaaagatgtaaatgattactttcatccatccattataacaaacctgaccacagtggaagctgtcttaaacttccttccctggttttatattaacccaactgatagattaagtattagtcaaaccactaaaaaaaaaa

SEQ ID NO: 733485 - DNA, 379 bp, Homo sapiens
attcacctgtgcaagctctcagctcacttgtctacctctgcagctcaactttccaggctgctctttgttagtaaatgatttggggctgcttttcatgaaataaaaagtgtgactgaggattcctcaaacccttgctatctccctaagtgatttctttttaacttctatatcaaagagactggagatttttttatgagaactgcatattgcctctttggtttggtttgttttaaaggcaggttatctgtggaaaccttatttatatattaatttgtttctcttactggagctgaaaaactttttaaggagggatactgtactattcaaatacctttctaaagtcccctaactcccagctttaaacacagctggtttccca

SEQ ID NO: 733486 - DNA, 910 bp, Homo sapiens
  misc_feature (75)..(75): n is a, c, g, or t
  misc_feature (109)..(110): n is a, c, g, or t
  misc_feature (427)..(427): n is a, c, g, or t
  misc_feature (638)..(638): n is a, c, g, or t
  misc_feature (902)..(902): n is a, c, g, or t
agatacagaccctgtgtgcttcccctatactggctgtggaggaatgacaataacttgttagcagggagattgcanacgtgcatgtgcaaaagctttgaaaaagaaaaannaagatgcccaaagtacgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagaactgaattcttgcaatgcataagatataaaangcaaatataactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatatnactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactanacttataa

SEQ ID NO: 733487 - DNA, 838 bp, Homo sapiens
  misc_feature (75)..(75): n is a, c, g, or t
  misc_feature (109)..(110): n is a, c, g, or t
  misc_feature (427)..(427): n is a, c, g, or t
  misc_feature (638)..(638): n is a, c, g, or t
  misc_feature (771)..(771): n is a, c, g, or t
  misc_feature (798)..(798): n is a, c, g, or t
  misc_feature (822)..(822): n is a, c, g, or t
agatacagaccctgtgtgcttcccctatactggctgtggaggaatgacaataacttgttagcagggagattgcanacgtgcatgtgcaaaagctttgaaaaagaaaaannaagatgcccaaagtacgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagaactgaattcttgcaatgcataagatataaaangcaaatataactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatatnactcccattttattgtgttagattgcagtacaatgaatgaataaggggatttatttaaaagatcttaactttcttgactgatttaaaaagctaatcaatttattaaagccagaaatgttctcctctggggggnaggccatttcctatcccttttatcctnccccctccccccacttcactgggntttgggttgggggttt

SEQ ID NO: 733488 - DNA, 910 bp, Homo sapiens
  misc_feature (75)..(75): n is a, c, g, or t
  misc_feature (109)..(110): n is a, c, g, or t
  misc_feature (427)..(427): n is a, c, g, or t
  misc_feature (535)..(536): n is a, c, g, or t
  misc_feature (538)..(540): n is a, c, g, or t
  misc_feature (542)..(542): n is a, c, g, or t
  misc_feature (545)..(545): n is a, c, g, or t
  misc_feature (551)..(552): n is a, c, g, or t
  misc_feature (555)..(556): n is a, c, g, or t
  misc_feature (558)..(558): n is a, c, g, or t
  misc_feature (574)..(574): n is a, c, g, or t
  misc_feature (576)..(576): n is a, c, g, or t
  misc_feature (587)..(587): n is a, c, g, or t
  misc_feature (602)..(602): n is a, c, g, or t
  misc_feature (608)..(608): n is a, c, g, or t
  misc_feature (615)..(615): n is a, c, g, or t
  misc_feature (619)..(619): n is a, c, g, or t
  misc_feature (624)..(625): n is a, c, g, or t
  misc_feature (642)..(644): n is a, c, g, or t
  misc_feature (649)..(649): n is a, c, g, or t
  misc_feature (902)..(902): n is a, c, g, or t
agatacagaccctgtgtgcttcccctatactggctgtggaggaatgacaataacttgttagcagggagattgcanacgtgcatgtgcaaaagctttgaaaaagaaaaannaagatgcccaaagtacgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagaactgaattcttgcaatgcataagatataaaangcaaatataactcactcatttcttggggtcgtattcctgatttcagaagaggatcataactgaaacaacataagacaatataatcatgtgcttttaacatatttgacnncnnnanccncccccnnccnncncccccctccccccccncncccccaccccncccccccccccacancccccnccccccnaccnccacnncgggggggggggggcgnnnggggnattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactanacttataa

SEQ ID NO: 733489 - DNA, 716 bp, Homo sapiens
attttttttagaggcaggatcttgctgtccaattttttttaaaaagctaaaattgccaactttagaatcttgaccaaaaaaaattaattttaggagcatctatttatgcagtgttcaaaagtactgaattagaaaccaggaagttttagttccttctactacctgtgtgatcttggggaaattatttaacctctcagtcctaattttccccttctgtataatgggagttctggatcacaatatgtctgggctctcattacccaaacatctgagattccatttttgccatgtgtcatcgagtcgctccccaacagatgtttgtgatgtttttgtggctgtcaccatggtgggattctttcagaatgagactcctggaaattcactgagtcagcagccttcacaccatctacccttaaatatccaaccccagcaatttatacaacgctgtcatatttttaaaaaaacaaaagtaagccatcctcaaataaggaaccccttggtagatattaaccttaaaaagggttttcattctcaaacaagatgctttgttctccaacaagatgttcatctcatcacttgcacttttgttttaatgtatggattcagattagactgagaaaaatggatggtattttcttaaaattgtgccaccttagagcccccccccttttttttttcttccttcactggataaataaaatatgtgaacaagtgga

SEQ ID NO: 733490 - DNA, 588 bp, Homo sapiens
  misc_feature (339)..(339): n is a, c, g, or t
  misc_feature (357)..(357): n is a, c, g, or t
  misc_feature (367)..(367): n is a, c, g, or t
  misc_feature (369)..(369): n is a, c, g, or t
  misc_feature (374)..(374): n is a, c, g, or t
  misc_feature (422)..(422): n is a, c, g, or t
  misc_feature (450)..(450): n is a, c, g, or t
  misc_feature (477)..(477): n is a, c, g, or t
tccatggtagccaatcaagcttccaaataaattaaattccatttcattaaagggaaaatccccgagccactgagtcttggcttgtcactgaagttaaatctgaacccaggtgtcaacagctgctctaactccccactctggcactgaggagtattcccctcatctacctctctaagctatgcacccctccccacgtcttccagctggggatgggggagtcatagaaaagcccccatctccatctgggatagggaccttccatcagccttaaccctgggaaatgcctgctgcccccagtgactcttggtttcgtctcccacatacagaagcagggtggangggaagggtgggtctcanttagcagggntncccanggcaagtcagcctcctccctccatgcctctctggtcagtgtgccttanggtggcctctcactcccaccactctggngcccttgggggaggactggggaggggnccgtgggagagccctgacgctggaaccttgtatacacaaataaaggaccagtcctcaacagacttctggagccgcctgcctggagttctaaaacttagggcagggctggaa

SEQ ID NO: 733491 - DNA, 773 bp, Homo sapiens
gcattccgtgctatgattcaggcctaattaagtgattgcgtctgggcacggctataaaccactagctgcttcaactggtaatccagtcagtaggcaactgcaggggctcgccactgactgaaggcagtggaaggttggcagaaggaggctgttcaaggctgtttttgccttcactatggcaaaaatcattttgaggcacctcatagagattccagtgcgttaccaggaagagtttgaagctcgaggtctagaagactgcaggctggatcatgctttatatgcactgcctgggccaaccatcgtggacctgaggaaaaccagggcagcgcagtctcctccagtggactcagcggcagagacgccaccccgagaaggcaaatcccactttcagatcctgctggacgtggtccagttcctccctgaagacatcatcattcagaccttcgaaggctggctactgataaaagcacaacacggaaccagaatggatgagcacggttttatctcaagaagcttcacccgacagtacaaactaccagatggcgtggaaatcaaagatttgtctgcagtcctctgtcatgatggaattttggtggtggaagtaaaggatccagttgggactaagtgacatcgtatcggttcctgttcagatgacatggggaagatgatggttcagccactggtactacgagaatgtttgtattacccacatttgaaatgatttgctatgatttttatgaagattaaaaatatatacacagttaaaaaaaaaa

SEQ ID NO: 733492 - DNA, 482 bp, Homo sapiens
gcaactgcatattgaaatttgttaaagcactcatctttatggaaattaatcattatcctaaagaagtgtttctctcccatcatccggatttctggttgtggcccagcaattaacaaaaacagcttcaactgttcgaattttatgaaccaatgtaactctggcctcaatcatattcctctgggatttctaaacagcagttaagctacaaaaagcaaacaaaaccacacatattgatggagtctgcattccaccacatatccacccttgagaagtatgtcaaaagactgcagactatagatttttttttaatataggattataaatcagctagtgaaagacctcagagcagttgtaagtagatctgccatctagaactcatattctaaagggaagtgatttctcagaacagtgatgttctggaatatgtattatttattttaacacttttttaataaaatctttattataaaccaaaaaaaaaa

SEQ ID NO: 733493 - DNA, 1161 bp, Homo sapiens
  misc_feature (443)..(443): n is a, c, g, or t
acccgcagcctgtgatttcctgggtgacaccccgaagcgtttcatcaccaccaagtccaatggaagagccaccgtgttgggtgatggcaccttggaaatccgctttgcccaggatcaagacagcgggatgtatgtttgcatcgctagcaatgctgctgggaatgataccttcacagcctccttaactgtgaaaggattcgcttcagatcgttttctttatgcgaacaggacccctatgtacatgaccgactccaatgacaccatttccaatggcaccaatgccaatactttttccctggaccttaaaacaatactggtgtctacagctatggggctgcttcacattcctggggagtggttttattttgttttccttctccctttttgtgtggagccgagggaaagggcaagcacaaaaacagcattgaccttgaagtatgtgncccagaaaaaacaatggtgctgttgtggaaggggaggtagctggaccccaggaggttcaacatgaaaatgatttgaaggcccacccctcacattactgtctctttgtcaatgtgggtaatcagtaagacagtatggcacagtaaattactagattaagaggcagccatgtgcagctgcccctgtatcaaaagcagggtctatggaagcaggaggacttccaatggagactctccatcgaaaggcaggcaggcaggcatgtgtcagagcccttcacacagtgggatactaagtgtttgcgttgcaaatattggcgttctggggatctcagtaatgaacctgaatatttggctcacactcacggacaattattcagcattttctaccactgcaaaaaaacaaaagaaaaaataaaaaagaacaacctacagtgtaggatttacatattaaaaagacacatttgtctaaaacatactctacagaaaaatttgtatctatgattatcatttgttaaagccttgcatcataccatattgttggttcagtaccacaaagagatcaatatattcttttcttccttttttgaaacatatatgctgtacatgttttaaagcaatatgaatgagaggttgtgcttttagttactcaccactatagatccaagtgtgatttcaccttccgttacctacagatgaccctgagactagatccctggagtta

SEQ ID NO: 733494 - DNA, 466 bp, Homo sapiens
ccatgagaatggaggccattcatagcagaactacgagacaagaggagcctaggtccctgagctgcagaactgcatactaacctgatgagaagactaatgctcagtgaggtgaactccttcagggccacaggctgtaaagatctaaacaccatctgatccagtttcaatatgactgcctggatgaagaaggatttgagactaagtttattcctccaaagcaaaccaactgagaatgcagtttctgaggaccttggctcatttcaaaatctggaaatatatttgaacacctctcccagaagtgggtaagaagttagaataatggaaaggcttggctccaagttcagttgaatgtcaaaaagcccaagtttggctgaatggactttgtgtcgtgaaatctcagctccctctctcttcttccaggccaaatacctactggatgaaactgataaaattaaacaaagagaga

SEQ ID NO: 733495 - DNA, 499 bp, Homo sapiens
atgagaagactaatgctcagtgaggtgaactccttcagggccacaggctgtaaagatctaaacaccatctgatccagtttcaatatgactgcctggatgaagaaggatttgagactaagtttattcctccaaagcaaaccaactgagaatgcagttttcaatgcaacccatcatcaaagggaaggagttgatgaaaagaaatgaaattgaaacgtgcacctggggagaagtgattgaaggttcttcatttaagggattggctccttttctcttattatactgtgaaatctgaaaacatctcttgaaattctggtcactgtcttctggacatcccaaggcgcaccatctccacagttcctccctcctagattatcccatccagtgtggcatccagtgtggcaaatggaaagactcttccagtgggcaactgaaaaggacaccaaagaaagcagatacagcccatgatcaaagaagcacataacttcagtttggaacatga

SEQ ID NO: 733496 - DNA, 1574 bp, Homo sapiens
  misc_feature (1241)..(1242): n is a, c, g, or t
  misc_feature (1244)..(1244): n is a, c, g, or t
  misc_feature (1252)..(1252): n is a, c, g, or t
  misc_feature (1285)..(1285): n is a, c, g, or t
  misc_feature (1290)..(1290): n is a, c, g, or t
  misc_feature (1458)..(1458): n is a, c, g, or t
  misc_feature (1479)..(1479): n is a, c, g, or t
  misc_feature (1483)..(1483): n is a, c, g, or t
  misc_feature (1487)..(1487): n is a, c, g, or t
  misc_feature (1561)..(1561): n is a, c, g, or t
acgtcagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgacctcgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggtggagtctgaagagccacaggacaatgacttcctcagttgcatgtcccggcgctcgggtctgcctcgctggatcctggcctgctgcctcttcctctccgtgctggtgatgctgtggctgagctgctccaccctggtgaccgcgcctggccagcacctcaagttccagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactgccaactgcagggggcccctcgggcctcacttgccctgagcccaggagtccaagggcagggtgggtccagccttgagcccctccacccccaaatccttcnncncctcccantcccaccccttgccccacggagtcctggggacncagtnccccagctgggaagagggcgggatcgggcactggttcctccttgtccccgctttcttgggggcttgctactttttgtcttctattgtgtggctttctgagtatttgaaccccagtcctgtgtcaccttcctttttccttctctgtcccctctctgcgggggggcgctnaggctgagggggagctgcgtncttngctnagggcttcccccccccccccccccccccctcccagagacccaccccctcagagacagcccctgccatctccatncccctacaaagcg

SEQ ID NO: 733497 - DNA, 952 bp, Homo sapiens
acgtcagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgacctcgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtgggtaaggtgcaacctagaccagtgttccttccatgggtggccccactgccacaaggagtcggcctggcaaacagaccttctaggatcgggatctccatctctcaagtcctgggttccatggctcatcccccaggtctccatggtctatttcccagggttccatggtccacctcccagggttccatggtccacttctca

SEQ ID NO: 733498 - DNA, 1093 bp, Homo sapiens
acgtcagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgacctcgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggtggagtctgaagagccacaggacaatgacttcctcagttgcatgtcccggtgggtggcaggaccttgggggtgggaggggggtgggactggaggtacgggtctccctggtcccggcctgggcagctgagtggtgcctgccgggcggggcaggcgctcgggtctgcctcgctggatcctggcctgctgcctcttcctctccgtgctggtgatgctgtggctgagctgctccaccctggtgaccgcgcctggccagcacctcaagttccag

SEQ ID NO: 733499 - DNA, 941 bp, Homo sapiens
acgtcagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgacctcgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggcgctcgggtctgcctcgctggatcctggcctgctgcctcttcctctccgtgctggtgatgctgtggctgagctgctccaccctggtgaccgcgcctggccagcacctcaagttccag

SEQ ID NO: 733500 - DNA, 963 bp, Homo sapiens; identical to SEQ ID NO: 15008

SEQ ID NO: 733501 - DNA, 685 bp, Homo sapiens
ccaggttccaagaggagacacctggagacgcaggcaggaaccatgcagacctctgtgacctagccacggaagtcatatagtatcaccactgccatacctcttggtcaaagcagccctgagctcacccatgaagagggatatagacctccacttctagacgggagaagtacccaggaattttaggggccacctccagatagttgccaaacccctcccacccacacttcactgtcactttggagatggagtgaacgtgccaccttcctgcttgctgtctccataaaggctgtgcacaccctgcttgaagaaagcttgggcgatgcgttttattttcaagtagaatgtggcaaagaccacttactttctctccagccacctccagatgcgcttgcaagctgtgcctgccattcttccagactctcctgtccagtgtgactcactttgccaacaacggaggcccagagtgcttctgtctccctccccactgcgcagggaaacagaacccagaccagcttctggatcagccctgtgcctgggatttctcactgaaacaaggtctcctggtgtcatttcctcccaatgctgtcctgggtgacactttccatttgagctgcttttttatataggccctagcaactaggggccgtgtcggaataacttcagacgagtcctttcactgttctta

SEQ ID NO: 733502 - DNA, 642 bp, Homo sapiens; identical to SEQ ID NO: 728848
  misc_feature (547)..(547): n is a, c, g, or t
  misc_feature (550)..(550): n is a, c, g, or t
  misc_feature (583)..(583): n is a, c, g, or t
  misc_feature (623)..(623): n is a, c, g, or t

SEQ ID NO: 733503 - DNA, 377 bp, Homo sapiens
gtttatcacccagcgcctatcacggctgaatcggtgtcccagctccacttttattctccctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaa

SEQ ID NO: 733504 - DNA, 702 bp, Homo sapiens
gtttatcacccagcgcctatcacggctgaatcggtgtcccagctccacttttattctccctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtcttctcatagaagggacacagagctgagatcgtgccattgtactccagcctgggcgacacagagagactccagctcagaaagaaaaaaataggtcactg

SEQ ID NO: 733505 - DNA, 610 bp, Homo sapiens
ctcgagttggtacctgccagtaccctcgacggtaaggcagatcaccgtgtacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaa

SEQ ID NO: 733506 - DNA, 469 bp, Homo sapiens
  misc_feature (457)..(457): n is a, c, g, or t
acatatacgactcgagttggtaccctctctccacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagggtaccaactcgantcgtatatgtaa

SEQ ID NO: 733507 - DNA, 652 bp, Homo sapiens
acatatacgactcgagttggtaccctctctccacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaa

SEQ ID NO: 733508 - DNA, 977 bp, Homo sapiens
acatatacgactcgagttggtaccctctctccacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtcttctcatagaagggacacagagctgagatcgtgccattgtactccagcctgggcgacacagagagactccagctcagaaagaaaaaaataggtcactg

SEQ ID NO: 733509 - DNA, 1365 bp, Homo sapiens
cttctccctcgagttgggacccgggaagaaccatgaagtggctgctgctgctgggtctggtggcactctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcactgtcctctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacag

SEQ ID NO: 733510 - DNA, 693 bp, Homo sapiens
cttctcccctcactttccacagcgatgaccagagtggcagcgtggtgatctttggtggcattgactctctccacaactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaa

SEQ ID NO: 733511 - DNA, 1018 bp, Homo sapiens
cttctcccctcactttccacagcgatgaccagagtggcagcgtggtgatctttggtggcattgactctctccacaactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtcttctcatagaagggacacagagctgagatcgtgccattgtactccagcctgggcgacacagagagactccagctcagaaagaaaaaaataggtcactg

SEQ ID NO: 733512 - DNA, 935 bp, Homo sapiens
ctcgagttggtacctgccagtaccctcgacggtaaggcagatcaccgtgtacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtcttctcatagaagggacacagagctgagatcgtgccattgtactccagcctgggcgacacagagagactccagctcagaaagaaaaaaataggtcactg

SEQ ID NO: 733513 - DNA, 1016 bp, Homo sapiens
caggctgctgatggctgagcagctgaccaccatgtcgccatctgagttctcgctggctccgatgacgctctggatgttggcaatgggtctggttgggccgggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacag

SEQ ID NO: 733514 - DNA, 526 bp, Homo sapiens
ctcgagttggtacctgccagtaccctcgacggtaaggcagatcaccgtgtacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagggagagagccagtgtggagagagccagtgtggagagagggagagagccagtgtggagagagggagagagccagtgtggagagagccagtgtggagagagggagagagccagtgtggagagggtcc

SEQ ID NO: 733515 - DNA, 427 bp, Homo sapiens
  misc_feature (415)..(415): n is a, c, g, or t
ctcgagttggtacctgccagtaccctcgacggtaaggcagatcaccgtgtacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagggtaccaactcgantcgtatatgtaa

SEQ ID NO: 733516 - DNA, 609 bp, Homo sapiens
cttctcccctcactttccacagcgatgaccagagtggcagcgtggtgatctttggtggcattgactctctccacaactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagggagagagccagtgtggagagagccagtgtggagagagggagagagccagtgtggagagagggagagagccagtgtggagagagccagtgtggagagagggagagagccagtgtggagagggtcc

SEQ ID NO: 733517 - DNA, 510 bp, Homo sapiens
  misc_feature (498)..(498): n is a, c, g, or t
cttctcccctcactttccacagcgatgaccagagtggcagcgtggtgatctttggtggcattgactctctccacaactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagggtaccaactcgantcgtatatgtaa

SEQ ID NO: 733518 - DNA, 649 bp, Homo sapiens
tacatatacgaatcgagttggtacctctcacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaa

SEQ ID NO: 733519 - DNA, 974 bp, Homo sapiens
tacatatacgaatcgagttggtacctctcacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtcttctcatagaagggacacagagctgagatcgtgccattgtactccagcctgggcgacacagagagactccagctcagaaagaaaaaaataggtcactg

SEQ ID NO: 733520 - DNA, 565 bp, Homo sapiens
tacatatacgaatcgagttggtacctctcacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagggagagagccagtgtggagagagccagtgtggagagagggagagagccagtgtggagagagggagagagccagtgtggagagagccagtgtggagagagggagagagccagtgtggagagggtcc

SEQ ID NO: 733521 - DNA, 466 bp, Homo sapiens
  misc_feature (454)..(454): n is a, c, g, or t
tacatatacgaatcgagttggtacctctcacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagggtaccaactcgantcgtatatgtaa

SEQ ID NO: 733522 - DNA, 568 bp, Homo sapiens
acatatacgactcgagttggtaccctctctccacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagggagagagccagtgtggagagagccagtgtggagagagggagagagccagtgtggagagagggagagagccagtgtggagagagccagtgtggagagagggagagagccagtgtggagagggtcc

SEQ ID NO: 733523 - DNA, 1015 bp, Homo sapiens
ctgccctcctcccgggctgataccctggaagccaagtcctgcatgagatgaaccagggtggctctgggcctgaggctggcatccagagctcagtgaacatgacccgatggtgaacatcatctcggtttccccacccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacag

SEQ ID NO: 733524 - DNA, 549 bp, Homo sapiens
ctcgagttggtacctgccagtaccctcgacggtaaggcagatcaccgtgtacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagagagagagccagtgtggagagagggagagagccagtgtggagagagccagtgtggagagagggagagagccagtgtggagagagggagagagccagtgtggagagagccagtgtggagagagggagagagccagtgtggagagggtcc

SEQ ID NO: 733525 - DNA, 632 bp, Homo sapiens
cttctcccctcactttccacagcgatgaccagagtggcagcgtggtgatctttggtggcattgactctctccacaactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagagagagagccagtgtggagagagggagagagccagtgtggagagagccagtgtggagagagggagagagccagtgtggagagagggagagagccagtgtggagagagccagtgtggagagagggagagagccagtgtggagagggtcc

SEQ ID NO: 733526 - DNA, 588 bp, Homo sapiens
tacatatacgaatcgagttggtacctctcacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagagagagagccagtgtggagagagggagagagccagtgtggagagagccagtgtggagagagggagagagccagtgtggagagagggagagagccagtgtggagagagccagtgtggagagagggagagagccagtgtggagagggtcc

SEQ ID NO: 733527 - DNA, 591 bp, Homo sapiens
acatatacgactcgagttggtaccctctctccacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagagagagagccagtgtggagagagggagagagccagtgtggagagagccagtgtggagagagggagagagccagtgtggagagagggagagagccagtgtggagagagccagtgtggagagagggagagagccagtgtggagagggtcc

SEQ ID NO: 733528 - DNA, 695 bp, Homo sapiens
tacatatacgaatcgagttggtacctctcacactggctctctctacactggctctctctctctctctctctctccacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaa

SEQ ID NO: 733529 - DNA, 1020 bp, Homo sapiens
tacatatacgaatcgagttggtacctctcacactggctctctctacactggctctctctctctctctctctctccacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtcttctcatagaagggacacagagctgagatcgtgccattgtactccagcctgggcgacacagagagactccagctcagaaagaaaaaaataggtcactg

SEQ ID NO: 733530 - DNA, 611 bp, Homo sapiens
tacatatacgaatcgagttggtacctctcacactggctctctctacactggctctctctctctctctctctctccacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagggagagagccagtgtggagagagccagtgtggagagagggagagagccagtgtggagagagggagagagccagtgtggagagagccagtgtggagagagggagagagccagtgtggagagggtcc

SEQ ID NO: 733531 - DNA, 634 bp, Homo sapiens
tacatatacgaatcgagttggtacctctcacactggctctctctacactggctctctctctctctctctctctccacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagagagagagccagtgtggagagagggagagagccagtgtggagagagccagtgtggagagagggagagagccagtgtggagagagggagagagccagtgtggagagagccagtgtggagagagggagagagccagtgtggagagggtcc

SEQ ID NO: 733532 - DNA, 512 bp, Homo sapiens
  misc_feature (500)..(500): n is a, c, g, or t
tacatatacgaatcgagttggtacctctcacactggctctctctacactggctctctctctctctctctctctccacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagggtaccaactcgantcgtatatgtaa

SEQ ID NO: 733533 - DNA, 491 bp, Homo sapiens
  misc_feature (479)..(479): n is a, c, g, or t
ctgccctcctcccgggctgataccctggaagccaagtcctgcatgagatgaaccagggtggctctgggcctgaggctggcatccagagctcagtgaacatgacccgatggtgaacatcatctcggtttccccacccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacaggtggagagagggtaccaactcgantcgtatatgtaa

SEQ ID NO: 733534 - DNA, 492 bp, Homo sapiens
  misc_feature (480)..(480): n is a, c, g, or t
caggctgctgatggctgagcagctgaccaccatgtcgccatctgagttctcgctggctccgatgacgctctggatgttggcaatgggtctggttgggccgggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacaggtggagagagggtaccaactcgantcgtatatgtaa

SEQ ID NO: 733535 - DNA, 841 bp, Homo sapiens
  misc_feature (829)..(829): n is a, c, g, or t
cttctccctcgagttgggacccgggaagaaccatgaagtggctgctgctgctgggtctggtggcactctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcactgtcctctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacaggtggagagagggtaccaactcgantcgtatatgtaa

SEQ ID NO: 733536 - DNA, 447 bp, Homo sapiens
accacacattcaaactataaggcctgtgttcttccaaacgtagttccaccactcccccgctgtgtgaccttgggcaggtggcctcacctccctcaggctcagtgtcctcatggtaagtggaaacaacagtgacggtgcccactgcatgggccctggcctaagaggaaaagaaaccacattggtcacaccccaggacagccctggaaagtgcccaatcaacggtcgctctgaggaggcaacagcagatggtcacacaaatggacgaacaaaaaaattcatgtcttctcccctcactttccacagcgatgaccagagtggcagcgtggtgatctttggtggcattgactcttcttactacactggaagtctgaactgggtgcctgttaccgtcgagggttactggcagatcaccgtggacaggtgagactgccatgaacgggcagcatc

SEQ ID NO: 733537 - DNA, 437 bp, Homo sapiens
gtttggataggagacattgtaaaactcaagaatgggaaaaaaaaattttaacagaagtatgtatgaaggaaatattttaagtataatctacccaaagaaaataactgctacagccaacattaaaggttttattccctgttttgttaagtaacttcactccaaattgtgacattctttagagaaaatattttccttaagagtagttatttacgtgttttattgggggagcatattttcaggggggcaacatcttgctaagaacatttgattagcctcacttctgtcctcaccttctatattgcttacttttcaagatatttcttctgagcccttttctttgtatgcccagctccctgttatgtaattaagtagttgattaccattccaaatgcttcccctacacaggctgttgtccaccctgtttcatgaatttgtga

SEQ ID NO: 733538 - DNA, 1056 bp, Homo sapiens
  misc_feature (4)..(5): n is a, c, g, or t
  misc_feature (653)..(653): n is a, c, g, or t
gcgnncacactcaaaacaaagagcatcaggatggcattggtcttaccacaagcagaatgctggaagacaatggtggaataccttcagaactctaagaaacaaatgatttccaacactgatttccaaaactggtttaattatgtcaagtctagggtgcaatcaacacattttagatatgcagaagctaaaacaatacttccctcgcaccctttcttgagaagctattagaggatgtgctttcagtaaccaagaaagcaggatgtggtagacaggggccaccacaatagaggatgctagctatgctcccagcctagaacacaactagtccagactggagtaggagggtggaagactaagggtaggaggcctccaagaaaaagcaaaatgcaaatggtaggttatgtgtttgagtactcagaaaaatggatagatgtcagaaagatattgcagtgattaattttatgtgtcaacttcactgggtcatagggtgcccagatatttggtcaagcattattctggtaataatatgtgtgtctttgagggtgtttctggacaagattaacattggaatcagtagactgaataaagcagacggccctcctcaaggtgggtgggcatcatccaatcagcttaaggccagaatagaacaaaanggctgaccctccctcaagtaagagggaaccctcctgcctgattgcttgtgttggaatttgtctcttcctgccttcagacttgaactgaattattggctgggtctcaagacttcaggctttcagactggaacacaacatcgactctcctgggtctccaacttgccaaatgtagatcttgggacttctcagcctccctaactatgtgagcctgttccttataatgaacctatttctatatatgcatactattggttttgtttctctggagaaccctgactaatacagatatatagaaatgtttagaaagtgatatatgtgataacatatgaaagaactgtagataactcttaaagaaaatgtcattttagacaattaaaatatttgtgctcaactgcttgaaaaa

SEQ ID NO: 733539 - DNA, 559 bp, Homo sapiens
  misc_feature (8)..(8): n is a, c, g, or t
  misc_feature (29)..(29): n is a, c, g, or t
  misc_feature (97)..(97): n is a, c, g, or t
  misc_feature (112)..(112): n is a, c, g, or t
  misc_feature (117)..(117): n is a, c, g, or t
  misc_feature (170)..(170): n is a, c, g, or t
  misc_feature (193)..(193): n is a, c, g, or t
  misc_feature (228)..(228): n is a, c, g, or t
  misc_feature (246)..(246): n is a, c, g, or t
ggacggcntggcctaaggctcctccaacngcaccatcaaggcccgggagcctgccagaactgatcccttggtgtgggaggactgggtaccacctacncccaacaagtcatgngggantctaattggtaggattttgacggttttgcaacataggtctattattagagtcnccatgacaaaaataggggttacnagatatgcccaagtcagcatttgtcctgggtcccntgtgtgatctgtttgganatgtttccttttcttctcccacttgctcagcagcttgggcttccattctagttcttttaccagatttttgtgtgacctgttgacttcatttggattgccctctttcaatttccttgtgaaaaacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaaaaa

SEQ ID NO: 733540 - DNA, 460 bp, Homo sapiens
agcaaaaataagaaaattaaaactacctataaatccaacatgcagagataaccactgttattaatctgttaatgactatatttttctaatatttttaagatttttatttctttttaaaagtaggatcatagtaaacatactgttttattagcctgctgtttttcactttacattatatcttggaaatacctccttgccatcagttactttcacgtaaccttttgatggttctcaccattgattgtaaatatttctttttatgtgtgagacttttgtggctttctcattttcgctgggggaatgtaacaagaagctcagttttcttttcaaaaataaaaatggcactgagtgcggtggctaatgcctgtaatcccagcactttgggaagccaaagtgggaggatcgcttgagcccaggagtttgagaccagcctgggcaacatagtgagacccgtctctgc

SEQ ID NO: 733541 - DNA, 474 bp, Homo sapiens
gaaaagcctgtgttcaggagggagttgccaaggcctcaagaaagatccctcctgagtgccagggattacagattcccaggggactttcctaaggcctcggctggcccctccagccctgctcacctcggaagctcagctcactgtcactaaccccacagtcctctgcagagctctccttctcctgcttgctgctgccccggctcctcttgacgctcttatagaactgcccccagcggtgccgccctgcatccttcttcaggcgtttctctttggcccttctgttctgaaaccaaacctgccacacaagcacaagggacatactcagggggcgtccaccacaaacccaaagcccccagggaccccctagggcgggcggctgggaagcagactgaagcctgaatgggagcacaggtcttggggagtgcgatgcggccccacccctttttccccagggtgggcctcagaactctgtct

SEQ ID NO: 733542 - DNA, 904 bp, Homo sapiens; identical to SEQ ID NO: 41156
  misc_feature (843)..(843): n is a, c, g, or t
  misc_feature (869)..(869): n is a, c, g, or t

SEQ ID NO: 733543 - DNA, 1909 bp, Homo sapiens
aacatgcaattcatcactgctcaccagagctggcaggcgacaggtcattccggggcgctttcaaagagcgcatgtagagatacacactcaagaccacacaaaaaacagtggccgcaagtgcaaactgaagaaaatgactgtacacgtaatgaaactctacgccctggaagagagatgttccgatgactgcagatgtcaggataaaagcatagaatcctttaaaaaaaaaaaaaaaaggaagtggaaaattaatattaacccaaggctcacatgaaacttacgccactatgaaacaatgcaatgttcatttttaaagtcttaatttcattattcagactaaatacacacaaatatgcaaataagcaatgtctgaggtataattttcaatatacataccattatctcttgtagaactttccaaatagtttaacatattgattctttttcagttcaaatggtcattatttgcttttaattaagggaaaacagacaagaagtgcaacctgaaaattcccacaatccaaactctcaggcacaaagtcaaatggctaattattaacagagctgggccaaacacatattttaaagtctaatgccattacctaaggggagggtattatgcacctaccaggggtcaggcaccgagccaggttggtagttacaaaattataaatatttatacttaaccaagttgccaataatggtttcaaaagattctagtaaaactctatcatccagaacagagatcttaacatgccacccgcagaaaagatgccacaacacaaatgcccgaggctaggcaggggactgcgagtacctggggggtagggacagcaggcggggacattcacgtgcaatgccaagttaaaaagcacccgccctgtgacgctccacagaactctcgttccgggctagtcctgcagccacacagaaaggctcactggaagatccaatttttttcttttggctaaagaaatagttttgctttcaaaggagctgagtgcctcaaagagctgtgatcctaaaaagtcatcaaatccatttggataaacggtcaaaagcaaaaaagaggtagctgttatttatatgagaattctaaaaccaaaccttttgtaaagtaaaatagttgtctcaaattatctgaatccacattttccacaaatactccaaacaataacttctaaattctgacttttgaaaatattcatttacctttcataaaatgtaattttaaaaaagaatggttagataaagcagtcttttgctctctagcctatgtggattaaaaataatcatccaaaatgtcttaggaacctccttagttaataatcgtaaaatctcgaaaagaaatctcaatacttgaaccagagtaattagatgaggaaatttttaaaaaggatcaagcaacttggccagccactcccccactggctccaagagctccatgtccaagtgctgtgctcagtctctgaatgtaccacacccctcagagggaagtgaaaatataacacaagattacttagaaaagaattggtacctacagagaaacacacaaaacactgaaatcaaaggacctggcggcaaagtcaacaacccacctcaccccagactcaccttccctggtgtggtaagtgaaccaccagagggagggagggtgccaaaggttctaaaacttgctccatcagcaaagaatttggtaaaagcaacaaaaagtctaacaataccaatgataagtattaagcacccaccaggggtcagactctggagctgggggagacgttttatcacatgactggcactaaaaggcagaaggtgtctaaactatctttggcttcccctttagaacccagtggagtgactgcagacagagtagatgctgcgtaagtctctaaacaaagtatccaaagtt

SEQ ID NO: 733544 - DNA, 1385 bp, Homo sapiens
tagaggatccccccagttcctgcttcttgaaaccagttccagggtcttggctttgcctactctccttcctctccaatgcaatgaatgacattcagaattccaggttgaacccccaagacctatgcctcacccccgacccaggcagcaggaactcagggagttctcacctggtctgggacctgcaggacagctcggagctgcacccagagtttgcaaaatgccacgtgccttggacacccaggtttgcctatggagtgttctatgcagacccctgcacgggaggtgattcttatcacccacatgagcaatcatctcccccaattttctctaaacagagctgggcattaactcctcttgaaaggggcaggaatggctccaagatcacctccaggaaaggccagagtgttctaatgacttgaaaacctgctcccggccagaagcagccactcatcttggaaccccctggctctcattttggcctctcgaggatatgggctgtgatttctgagcacccagggaacacagttggctgattcctaatcaacctagttgtacaggggacaaagtcagaggggcaatcaaactcgcaacagaactcgaatctacaagcctgacctgactcagggatctcgccttgtcaccgacacacaagcacggcccctttaccaacgtgttcattgttttgtttcaaaaggcaatgcggcagcgggtccttgggagccagctctagtatagcactggctaattttttaaaaacgtctgttggctgtgagtgaatgaatgaagggatgaagggatgaatggatgagttacaaccactgccaccctgtggaggaagctgaaaggctgaaagcaaagctcatgggagggaccatgcgccaggcaaggtgaggcctggggaggacttctccgctcatgggtgggagggcttggccccaggctactcttgaccccgaccctgggtcacagtcgtggtgtgtgacacatggaaagcaccatggggaagaagctatgggtgacagtggcagacgagatccagctgggacgtgctcagggcagtaaccccggaggaggcagctacaagaaagggtgtttgcttcataaccacagcccatggcgctacacagcccacccaaaatgaaagggtttgctttcaggagaagaaaaggccaaaagcacggggtcaagataagtaggccaaatgcatggatgggtagatggagcaattcatgttgaaagtcattgccggcctcccaaactcggataccaagctaaacatgtgggtgagggattctgacacgggcaaacagtgctcagtgctatagtagagggatgggtgggcagaagcagctctgctgagagcggaggatgctctggaaagaagg

SEQ ID NO: 733545 - DNA, 668 bp, Homo sapiens
tcttccttctgaccagaaacacacatttgggggtggctacgtctttagggtgctacttaaaacagcagactgagttgaagcacagctttgccacagggcctttgtctcattgtcactctgtgtgactaacctgtgtaatcattgtgttgtcatcagtacctgtataaaaacaggatctgtttgggattaccagaagcttcttaatgacagtgtcttctcatgaatgtagtgtatattttttacagtttatttttgcctatctttttgttttaaaaactttcaaacctgcataaaacttaaaataagaggataattaattcctgaatacctttacccagaatcgccagttgctagccattggctacattctggcactgtattctttccttaatacaagaaatacagaggtgaaagaagcctaggagatagttttattattaaaattagggtgattagcctgagcagcatgatgaggccctgtctctaccaaaaataaataaataaaaaaatacagaaattagccggttagtacacatgcctgtagtctcagctacttaggaggctgaggtgggaggatcacttgggcctgggagttggaggctgcagtgagctgagatcatgccatatcactacactccagcctgggtgacagagacagaccctatctc

SEQ ID NO: 733546 - DNA, 527 bp, Homo sapiens
tttcttggatgaaagccccatagtttgaattaaacaccccagactagttcccgttgcagcaataatgccggggttctcctcacaactcctccaccagaaacactctccaaacaaaaactgacggcctcaagaaatggcttctgattgacttcaggaaagcaagagcacctttacaccttctgagcgaactgccggactgggttctccagcccagatcttccttctagagactactcagcgttctccagctgggggaagagggaaggagacaccacaccgacaaaccccagaccatttgcaggatttgtaacaaggacacttctctttaagagcacctcctcctcctgcgtaggccgcaggtcagggtgactggttggaaccactgagtctttaaaataaagttagaggcaatcatgataatttagtttacttctgaatattttaaatattacgaaaacaagtataacagctttgttttcaaaactcttttgaggtatcagccattaaaagattaaggtttttgtaaa

SEQ ID NO: 733547 - DNA, 716 bp, Homo sapiens
gttttgggggacacttgaacactgactttggtgttttcccctggttgaggatggccctatggatactgagtttcctagaactaggggaccctaaacattcattgtaatgaaagcagatagattgtgagcataattactcccagaatgttgatgtaaagctgagagtaaatgggtagtttcttacaactaattgttcagtgtcaccagcacacctcactgagggggaaactgtccacccagcacgctgcatccagccctgctctgtgagaccacctcattcccattcagtctctttgttggccaggagtccataatggtgtgtgcatgtgggggagggggatcttttcctgccaatctacaaacctagcctacaaagcttcacctctacaatatgtactgaaagtaaagtgataaggaataattatgattgagattattattggccaccctaatataatgtacataataaactttatcatcataaacaaccacatttatactctgttgtgcccaagatactgtcttaggtgtcagcaattcaaagaataacatagagtccctattttcaatgtgcttactctctattctggacaataggatatttattcattcagtgacagtgactactaaataccatgaaagatacaaaaaagaaaaagaaatggtatctacagtaaaagattttacaaaggcaatcaggcaagcattcaaataac

SEQ ID NO: 733548 - DNA, 2902 bp, Homo sapiens
  misc_feature (2092)..(2092): n is a, c, g, or t
aacaactttagtacttggctttgtgtgaaagaaaacagaattccctatgtaatacccaacacaccatactcatgcaataaatattggtgaatacaggtgctgtactagagatgacaaaagtacaattaagagtcctatttttcactggatctactagttgaataaggatgccatatactaaagcatagaaaagttaaatatccattccctataaaatctaagaaatactatgcagtaatatgtcataaattgccaaataataatttactgtaatacagaaaaagatctgcacctatgtatgaaaagattctcagaaaactaagaataaagggaaattctaacttgatacatcctgtgcacctcaagtctatagcaaaagttacatttcattgagaaattttgagcacaatttaagtaagaggagaagataagaaagaagaaataaagttcactattcgtatatgatatagtcatttgtataaaatccaaaacagcaaactactagaactgagaaaattcagcaaggttgtctaatataagattaatttataaaaagcagttgttttttctataccgagagatcagcaatcttttttaaatgttttcagctttgtgggccatatggtctctgtcataactataactgctgatgtagtatgaaagcagccttagacatcatgtcaagacatggcaatgcctgtgttccaataaagctttctttgtaagtagatggcaagcttggatttggcctgtgagccataaatttctaacccctgccatttatcatgagaaacccacttagaaaatagtctaacaaaaattaacttaattaaaaacgcataaaaccttcatgggaaaaaaaaaatctaagtttattagaaaataaaagattgttatgtgatatatggcttaacctagtaatgcctgttttctttaaagcacatcagtgtctcctgttcaaaattttttttttcctagaaacttgacaaattcattttaaagttagcatagaccaatacaggtccagaattagctgagtcagttttgacagaaagaggaaggaaggaacactagacctacaaggtaaatgagagttactgtaaaattatactaataaaaacaacataatgctagcaaaagaaaggcaaatagattggtataaactagtaatctcagaaagattcatgtatatttgacaacttggtatatgatgtggcacaactaggtagtgaggttgcttaaagaagatgattatttagatttagtaggagtactggctatttggaaaaaaaagctagatccctactttcaactttatatgcaaaggctaactcttgaaggattaaagacctaaataagaaatataacacttatatttaatgaattcacttatatttagtgaatattcacttatatttagtgaatagtaggctgggcatggtggcttatgcctgtaatcccagcactttgagtggtcaggagttcaagaccagcctggccaacatggtgaaatcctacctctactaaaaatacaaaaattagctggtatggtggtggacacctgtagtcccagctactcgggaggctgaggcaggagaatcacttgaacccaggaggcggaggtttccgtgagccaagatcgtgccactgcactccagcctcggtgacacagtgagactctatctgaaaataaataaataaataaatgtgaatagtagaaattttggagaataactacatcatagggatcatagaacataatgttcaaatttagtagatctgattacatcagaattaaagatttctgttaaaagaactatacacagagttaaaagtcagatgtcagctttggaacttttaaaacctaaagggaataatacctgtaatatattaagaactcctaaaagttaacagaaacaaagaacaatagcttttaaaaaaataggtaaaagatactaacagacaatttaaataaagggtagctaagtgctaacaggtagatgagaagatagacaaactcactagtaatcagaaaaaaatgaaagtaaatgagatacaatttttcacccatcaaaatgacaaatatttaaangttttctgatgccaagtattgggtatggtgtagatatctgtgtacttacgatgtgagtgtaaactaatattgtcattctgtaaaccagtcaataattaaatcagaagtgtttaatccctctgacccagcactcagaggaatttttaaacagatctttgaggatataatctttgtagctgcatagtttgtagtagtggggatttggagatagcctagctaaatatccatcactggtaaatagagcaaataagaaaaatgaaatgggagtaacaatggtgagatctttaaaactagatgaaactttaaaacatacagttgagagaaagaaacaatgagattcataaatatttaagaaaatagaaaaagcacagtagaaggaaatcggagtagagataataggaggaaagaggaaacaagtttgaggaaatatcacttgctaaatttatttatattatatttctatagatgaagcaaggatgatacagattcttttttctggatgaagcctggcttgaaaaaaaaacaaatggggctgggcacggtggctcatgcctgtaatcctagcactttgggaggccgaggcaggcagatcatttgaggtcaggatttcaaaaccagcctgatcaacatggtgaaaccccatctctactaaaaatacaaaaattaggcatggtagcaggcgcctgtaaccccagctattcaggaggctgaggcaaggagaattgcttgaacccaggaggcagaggttgcagtgagccaagatcacaccactacaccccagcctgggtgatagagtgagactccatctca

SEQ ID NO: 733549 - DNA, 1328 bp, Homo sapiens
gagagcagaccaggcccggtggagaattaggtgctgctgggagctcctgcctcccacaggattccagctgcagggagcctcagggactctgggccgcacggagttgggggcattccccagagagcgtcgccatggtctgcagggagcagttatcaaagaatcaggtcaagtgggtgtttgccggcattacctgtgtgtctgtggtggtcattgccgcaatagtccttgccatcaccctgcggcggccaggctgtgagctggaggcctgcagccctgatgccgacatgctggactacctgctgagcctgggccagatcagccggcgagatgccttggaggtcacctggtaccacgcagccaacagcaagaaagccatgacagctgccctgaacagcaacatcacagtcctggaggctgacgtcaatgtagaagggctcggcacagccaatgagacaggagttcccatcatggcacacccccccactatctacagtgacaacacactggagcagtggctggacgctgtgctgggctcttcccaaaagggcatcaaactggacttcaagaacatcaaggcagtgggcccctccctggacctcctgcggcagctgacagaggaaggcaaagtccggcggcccatatggatcaacgctgacatcttaaagggccccaacatgctcatctcaactgaggtcaatgccacacagttcctggccctggtccaggagaagtatcccaaggctaccctatctccaggctggaccaccttctacatgtccacgtccccaaacaggacgtacacccaagccatggtggagaagatgcacgagctggtgggaggagtgccccagagggtcaccttccctgtacggtcttccatggtgcgggctgcctggccccacttcagctggctgctgagccaatctgagaggtacagcctgacgctgtggcaggctgcctcggaccccatgtcggtggaagatctgctctacgtccgggataacactgctgtccaccaagtctactatgacatctttgagcctctcctgtcacagttcaagcagctggccttgaatgccacacggaaaccaatgtactacacgggaggcagcctgatccctcttctccagctgcctggggatgacggtctgaatgtggagtggctggttcctgacgtccagggcagcggtaaaacagcaacaatgaccctcccagacacagaaggcatgatcctgctgaacactggcctcgagggaactgtggctgaaaaccccgtgcccattgttcatactccaagtggcaacatcctgacgctggagtcctgcctg

SEQ ID NO: 733550 - DNA, 477 bp, Homo sapiens; identical to SEQ ID NO: 43211

SEQ ID NO: 733551 - DNA, 878 bp, Homo sapiens
aggaaaagagcgggaaggggagtggaaggcaggggctgaagacacaggccaggcggaatgaagatgatggtggtcttgctcatgctgtcctcgctcagccggctcctgggcctcatgaggcactcatctctcaggcaatacctggactctgtgcccttgccaccctgccaggagcaacagccaaagctagtgccgagctagaccacaaggcctgctacctgtgccacagcttgctgatgctggccggggtagttgttagctgccaggacatcactccagaccagtggggcgagctgcagctgctgtgcatgcagttggaccgccacatcagcacgcagatccgggagagcccccaggccatgcaccgcaccaatgctcaaggacctggctacccagacctacatccgtttggcaggagctgctgacccacttgccagccccaggccccagtatttcagcccctggaaagacatctaaagggacagggtcagggcagcccagggctcctggcttcagcaggaagtgaacaggctcagggaactggaggaagcgaagcatcaaggccagaggaggccacatgctgaccagcctgatgaggcaagagcctgcccctgccaccgccccgacccctctcctctctgcaagagcctgcctctgccaccgccccgaccccctctcctctcagcaagggatgggcctctctgcctcgcccacccctcagccgctcctcccagccatctcctcttccctaaggcctctgtctccatagctctggtttccctgggcctcagtcctccccaccctccttcctctgtctccctgtcactaatgtgaggtttctttgtgcacattaaagtcttctttcagcatcagtggtt

SEQ ID NO: 733552 - DNA, 530 bp, Homo sapiens
aacacatagtaagttactttcatatccagaaagtttagatagaatgatttctatgtaagcttttactgtgtagtctgagtccatgaatattgattacaaaaaacacatctgtaggtgagttacaatacctcacttataattcaaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaaggcataacaggttttgaattctgttagaatagttgtttttactatcttttaattttatacaaatttcaaagttacgtaatacttttatttaaaaagtgaaacaaagcttt

SEQ ID NO: 733553 - DNA, 2144 bp, Homo sapiens; identical to SEQ ID NO: 43635

SEQ ID NO: 733554 - DNA, 2519 bp, Homo sapiens; identical to SEQ ID NO: 43637

SEQ ID NO: 733555 - DNA, 2465 bp, Homo sapiens; identical to SEQ ID NO: 43636

SEQ ID NO: 733556 - DNA, 1446 bp, Homo sapiens
taaaatatgtgaaatccccttttgttctgaggattctttagtaggcaggagtgaccagattggaatatgcttggctggaaaaattaagattcaacttaacagactgttaataaccagaaccatcttctcttccgtaatgtggatttgccactgcaggtcaccctacaatgctatgttagaggtacaacactcctaccctcaggctataaacaaggtgaattattatctttatatctcttcatttagccctgatttgctgaagtgaaggcttgcttgagagttggttgcattataatttggtgagaatttaatctctcaatgacaacttacttgattccctcattctctttctgctacatagatcacagtagaccttggcagacagttctgtagttacataggtctgaattcaaaatccagttctgccacttggcggctgtgtgaacttaagcaagtcaggcaatgtttctgatgttttcttttcctcctccacaaagaataattaacatctaacaatagggtctcagctagttgttttaaaaatggttagagagatgtgtggaatgaagtaagtgtgcagtaagtgttaactacaaatattattatcttagacatacagatttccatgattcatgaatggtgaagcatcttagaagacatccattctaagccaggcatggtggtgtgcacctatagtaccagttgctcagtagaatgaggcaggagaattgcttgagcctaggagtttgaggctagtatgggcaatatggtgagaccctatctcaagaaaaaagcaaaactttttttaaagcttaaaaagagagacatctgttccactactctcatcttagaggccagaaaactgaggctcagataatttcagagactttcacagatcccccaaccatttgatggcaaagccaggaatagaactctgctctcctttcccactgggacagtgggacagactgaccgatttttttctccacctctgctgtctcagcaatggtttgggacagtgtggatggaccagaagctggatagtacagagccagggataaaaagttcaggcttcctgaagggaagctgcagtcctccctaggccacaacaccttcgagatagaataaatacagcacccttctctacccaagttaggaaaggaagaagtgttacccaattagttgtatggggactgccaaagcacgccagtctgaagatgagcagaaactggctcattccatttggcacctagcacactaactgcaccagttaataggccacgcttttctccagagccattggctgaagagttcaaataaaaagtattgagaataggctatccaaaacagtaggctcagatgctatcacacaaagcactttatccttaagttcaatttttctaaattgtagttggctgctttggcttaataaaaaccttcataaaa

SEQ ID NO: 733557 - DNA, 687 bp, Homo sapiens
ggtcctctttacttgtccttaaaccgcacatgtgtatttttatttctttgaggaagactgggtggcaggcacctgtgtgtgtgtctggaaacatatagcaagctagaggcagatttcaggcaaaaaaaaatgctcttttgggctgggcgtggtgactcacatctataatctcagcagacaggtggatcacctgaggtcaggagtttgacaccagcctggccaacatggtgaaacctcgtctctactaaaaatacaaaagagctgggtgtggtggtgcatgcctgtaatcccagctgctcgggaggctgaggcaggagaatctcttgaacctgggagatggaggttgcagtgagctgacatcgcagtactgcactccagcctgagcaaaaaaaaaaaaaagaaaaagaaaaaagagcccttttatttaagtatttaaccagaagagaaactaaggatcagagagaaaatgtgggaaaagaaaaattgtaggcagaaggttttacctggctgaaaatcatccacaaatgattttctttctcctcaaaacattgagtctctctctctttttttttttttctgctgtgttgcccaggctgaggcaagagaatctcttgaacccatcttggcagtgagctgagattgcgctactgcacaccagcctgggcaacagagcaagactccatctaa

SEQ ID NO: 733558 - DNA, 1165 bp, Homo sapiens
  misc_feature (8)..(8): n is a, c, g, or t
taaaattngcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcacacagcaattcagggagcaaaaaatgtgctgaggagactgtttacctaaaggttgttcttggtgctattccttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgcaa

SEQ ID NO: 733559 - DNA, 379 bp, Homo sapiens
  misc_feature (152)..(152): n is a, c, g, or t
  misc_feature (378)..(379): n is a, c, g, or t
ttccagtgaaataatagaaaacttttattagcagcatcttaaaaagtagggaaacaaacaccccagtctcttgataaaaatgagtctcttgggccaggcgtggtggctcatgcttgtaatccccagcactttcagaggcccaggtgggcagnatcacaaggtcaggagttcaagaccagcctggccaaatggtgagaccacgcccccccccccccatctctactaaaaatacaaaaattagccgggtgtctgttgtcccagctacttgggaggctgaggcaggagaattgcttgaacctgggaggcggaggttgtagtgagccaagatccaagatcgtgccactgcatcccagcctgggcgacagagcgagactcttnn

SEQ ID NO: 733560 - DNA, 784 bp, Homo sapiens
aagtactgtggttatgtaggagtgtccttgtttttaaaaagtatacacttaagtatttagtactaatgggacatcacaattgcaacttagtaacaaacagttcaaaaaataatgtgaatacatagctagagagtggtatggaaaatatggcaagatgttaacaatagaagaatctaggggaaggatatacaggatcttttgaactattctacttttctgtaagtttaaaattatttcaaaatagttaacaaataagacaagtagtatttgagctgttaggaatttgtcacactgagatttttgttgtttttgagacagggtctcactctgtcacccgggctgggagtgcagtggccgcgatcattaggctcactggaagcctcaatctcaagggatcctcctgcctcagcctcctgagtaactgggactacaggcatgagccaccacacctggcccaatttttctgatttttaatagagatgagttctcacccatgttgcccaggttggtctcaaactcctgagctcaagcaatcctcctgcctttagcctcccaaggtgctgggattacaggcgtgaaccactgtgctgggcctacactgatttttatactattagaaaaatctctacttaacggtttcattatcttaggtaaaagtattcaatagaatagctgaaataaatgtgaagcttttcttaataggcagtaattagataaaatgaacaacattctcaatcctcctcatgccacataattctctccctgcaagtttgtctcaaaaaaa

SEQ ID NO: 733561 - DNA, 450 bp, Homo sapiens
acctgacagctcactgctcagattacttttctaaaatgagatgggagagaaacagatgtttgctctttccaagaaattgatacacatgctgatttctgtgccttttttacttgttctttccgtagaatgtacaccctccactctaacaccctactctaaccatccttgaacacctatgtaacatcacctttatcagaaaacttctcagccagatacagaaatcattccaatgacctgacctgtgttcacacagaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtatggtaggctggggaggagatgcagcaagg

SEQ ID NO: 733562 - DNA, 1328 bp, Homo sapiens; identical to SEQ ID NO: 306883

SEQ ID NO: 733563 - DNA, 428 bp, Homo sapiens; identical to SEQ ID NO: 306885

SEQ ID NO: 733564 - DNA, 1661 bp, Homo sapiens
gtgagaagtacgtccactcttctgtccagcttttaacaatctaactaatgccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggaccccaagaaggccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatttggcgtataagccactctacagctgggaggaagccaagcagaaaacggtggagtgggttggttcccttgtggaccggcacaaggagaacctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatg

SEQ ID NO: 733565 - DNA, 1683 bp, Homo sapiens
gtgagaagtacgtccactcttctgtccagcttttaacaatctaactaatgccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggaccccaagaaggccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatttggcgtataagccactctacagctgggaggaagccaagcagaaaacggtggagtgggttggttcccttgtggaccggcacaaggagaacctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatgtttaatgtggagggaggtgtga

SEQ ID NO: 733566 - DNA, 441 bp, Homo sapiens; identical to SEQ ID NO: 306894

SEQ ID NO: 733567 - DNA, 419 bp, Homo sapiens
tacaatcgagctcggcccagttttacatgagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatg

SEQ ID NO: 733568 - DNA, 1029 bp, Homo sapiens
gtgagaagtacgtccactcttctgtccagcttttaacaatctaactaatgccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctagtaagtaaacttgggtcatgggtgtgtggttccatcttaaacactgcatgtatgtggggggagatggaccttgtctagcaagttattgaaatttgtagccaaatctaagccaatctcacatccaaagtcatcaagaaataaatattaaatagtataaaatggcatagtatgaaagatactgggtgggatttccagagactagattctggccctgacccagaacttgagaagcagccacctcagcctccaggcctcttttcttctcatctagaaaatcccacatcagttctttgtcttgtctgcaactcttttatgttctgaagcttttgtcttggcaattgctgtacaacattcataaaggacactattaccctggagacctcaccaatgggtcattgtctctctagaacgtgccaggctgtgttttgttttgcagcttccttagtatcctttgtgagggcaaaataaaaggaagttaaggtaaagatgagtgtataagtgggtgtgtgtgacagagagagaggaaaacaataagggggagagagagtcggggagagagagtcggggagagagactcagagagagagacaatgagaaagacagagaaataatgaaaaatatatagtgagagagagagcatcagtgagagaatgtgtgtgcacagtgcacagcacagagcagagacagagtaagaggcagtataaggccagacatgcctcatttagattttgcatatatggctttttttt

SEQ ID NO: 733569 - DNA, 1738 bp, Homo sapiens; identical to SEQ ID NO: 306889

SEQ ID NO: 733570 - DNA, 1716 bp, Homo sapiens
tattgaagagtttatattgcctatatacaatggtgtatgtgtgtgtgtgatgtgaattcttcaactgcccattttgcctaaggactggaactgtccatattcacagagtatagcctcctgattttttagattttaaatgatctgactttaatggtactgattacaaatcataatttgtcaatacccttacttggcaaaataaaaagtgataaccctaggtccctttccaaaattaaagtacacacacacacacatccatgaaacccaaaagtctagaaattcttactctccagaacccacatgtcagtttctcttcattttggtatttttcttatggctgtagtacgaccaaatctcagacagaaccacagaagaatgtaccctgagtctgttacaaccaccatatttgggagtggggggtggggcacatagatctgtgttcgtggttggcacctcttagggatatatcctgacagtgacaatatgctcttcatggacaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggaccccaagaaggccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatttggcgtataagccactctacagctgggaggaagccaagcagaaaacggtggagtgggttggttcccttgtggaccggcacaaggagaacctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatg

SEQ ID NO: 733571 - DNA, 1707 bp, Homo sapiens; identical to SEQ ID NO: 306888

SEQ ID NO: 733572 - DNA, 1685 bp, Homo sapiens
gtttgcaaaaaaaatggggtggaggaaaatgaggcatctgtgtgagtatataaccatttgacatctctttttagccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggaccccaagaaggccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatttggcgtataagccactctacagctgggaggaagccaagcagaaaacggtggagtgggttggttcccttgtggaccggcacaaggagaacctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatg

SEQ ID NO: 733573 - DNA, 874 bp, Homo sapiens
gtgagaagtacgtccactcttctgtccagcttttaacaatctaactaatgccctctccagggtcaccctagaatcagatctgctccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatttggcgtataagccactctacagctgggaggaagccaagcagaaaacggtggagtgggttggttcccttgtggaccggcacaaggagaacctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatg

SEQ ID NO: 733574 - DNA, 723 bp, Homo sapiens
gtgagaagtacgtccactcttctgtccagcttttaacaatctaactaatgccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctagaccggcacaaggagaacctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatg

SEQ ID NO: 733575 - DNA, 450 bp, Homo sapiens; identical to SEQ ID NO: 364807

SEQ ID NO: 733576 - DNA, 3850 bp, Homo sapiens; identical to SEQ ID NO: 364806
  misc_feature (3846)..(3849): n is a, c, g, or t

SEQ ID NO: 733577 - DNA, 3810 bp, Homo sapiens; identical to SEQ ID NO: 364812
  misc_feature (3806)..(3809): n is a, c, g, or t

SEQ ID NO: 733578 - DNA, 325 bp, Homo sapiens; identical to SEQ ID NO: 364808

SEQ ID NO: 733579 - DNA, 536 bp, Homo sapiens; identical to SEQ ID NO: 364810

SEQ ID NO: 733580 - DNA, 185 bp, Homo sapiens; identical to SEQ ID NO: 364809

SEQ ID NO: 733581 - DNA, 566 bp, Homo sapiens; identical to SEQ ID NO: 364811

SEQ ID NO: 733582 - DNA, 433 bp, Homo sapiens
tccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctg

SEQ ID NO: 733583 - DNA, 2006 bp, Homo sapiens
gatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacggatgactccaaggaagctcagatgcctgcagtcattaggttttagcgtcccatgagccttggtatcaagaggccacaagagtgggaccccaggggctcccctcccatcttgagctcttcctgaataaagcctcatacccctg

SEQ ID NO: 733584 - DNA, 969 bp, Homo sapiens
  misc_feature (54)..(54): n is a, c, g, or t
  misc_feature (57)..(57): n is a, c, g, or t
  misc_feature (100)..(100): n is a, c, g, or t
  misc_feature (104)..(104): n is a, c, g, or t
ccccgcaagacggggggcgcaccgtgtcgctcgccgggcggcgggaggggaganacntacggtaagaaaggagtttgtgaaagcgtcttgcgggggctgnccgnagcccccgcaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacggatgactccaaggaagctcagatgcctgcagtcattaggttttagcgtcccatgagccttggtatcaagaggccacaagagtgggaccccaggggctcccctcccatcttgagctcttcctgaataaagcctcatacccctg

SEQ ID NO: 733585 - DNA, 2050 bp, Homo sapiens
gatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctg

SEQ ID NO: 733586 - DNA, 1013 bp, Homo sapiens
  misc_feature (54)..(54): n is a, c, g, or t
  misc_feature (57)..(57): n is a, c, g, or t
  misc_feature (100)..(100): n is a, c, g, or t
  misc_feature (104)..(104): n is a, c, g, or t
ccccgcaagacggggggcgcaccgtgtcgctcgccgggcggcgggaggggaganacntacggtaagaaaggagtttgtgaaagcgtcttgcgggggctgnccgnagcccccgcaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctg

SEQ ID NO: 733587 - DNA, 595 bp, Homo sapiens
gcgcggcgcgccagcaacactgcacgcaggtggcaccggcggctcatgaaggagctgcaggacatcgcgcgccttaggaccgcttcatctccgtggagctggtggacgagagcctgttcgactggaacgtgaagctgcaccaggtggacaaggactcggtgctgtggcaggacatgaaggagaccaacaccgagttcatcctgctcaacctcaccttccccgacaacttccccttctcgccgcccttcatgcgggtgctcagcccgcgcctggagaacggctacgtgctggacggcggcgcatctgcatggagctgctcacgccgcgcgctggtccagcgcctacaccgtggaggccgtcatgcgccagttcgcagccagcctggtcaagggccagggacggatctgtagaaaagctggcaaatcaaaaaagtccttcagtcgcaaggaagctgaagctacctttaagagtttggtgaagacgcattgaaaaatatggttgggtcaccccgcccgtgttccgacggctgatgtctgccacgtgcagtagacgctcgagcgcctgtccacacacacaccagtaccctgacatctcc

SEQ ID NO: 733588 - DNA, 530 bp, Homo sapiens
aatggactctcatctgcctactcctctactctcccgtcccgtgacagtccctcctacccaccctccacgagccatgtggcacttgccctgggctgattgggctgcctgcttggcccatggggagctgtgttaaagtgagagttgtgcctgctgtatctttttgtgtgtagaaagatggggttcattcagatcccaagtcctttccccaaccctcaaagtgaagcctcctagggatgaagagctggtcagcctggactttaaatacctaatgtggcccagccttggttcccaaaccctgccttccctccctgtgcttttgggtgggaaacgggggatttgtatctcccttcctcctccttctccatgtgggtggcctctctaggtttctctgtgttctctgatccttggagagccagagccaaggcagtcatcttgttcccccttccacggccaggctgggtgccttcaggtgaccaggggcagagtgtaagtcaccaggttcaatggggtgaggggagaaccaccttaag

SEQ ID NO: 733589 - DNA, 2824 bp, Homo sapiens; identical to SEQ ID NO: 69437

SEQ ID NO: 733590 - DNA, 5428 bp, Homo sapiens; identical to SEQ ID NO: 69438

SEQ ID NO: 733591 - DNA, 2926 bp, Homo sapiens; identical to SEQ ID NO: 69160

SEQ ID NO: 733592 - DNA, 3202 bp, Homo sapiens; identical to SEQ ID NO: 69161

SEQ ID NO: 733593 - DNA, 3030 bp, Homo sapiens
ggtgacaacgtttggaagggccagggcgaccggcagtgtgcacagggactgtgtcgggcttggacctcacctgatcctctctcttagcgcgacccttcctctgctccctgtctcctctttctgccacttgtgcgctgcttccgcgcactcccggctccctagcggcaggaggaggaaggcgcacagcgggtggagagggtgcgccaaggagaggtaaccccttcgggagcccggggaatcccggccgccaccaggggccgtgccaccgccctcgcgggaccaaagcttccggcgtgtccccaactttgtggcgccctcaggccgcggcgactgggttagagatgccttccagcggcagagcgctgctggactcgccgctggacagcggctccctgacctccctggactctagtgtcttctgcagcgagggtgaaggggagcccttggcgctcggggactgcttcacggtcaacgtgggcggcagccgcttcgtgctctcgcagcaggcgctgtcctgcttcccgcacacgcgccttggcaagctggccgtggtggtggcttcctaccgccgccccggggccctggccgccgtgcccagccctctggagctttgcgacgatgccaaccccgtggacaacgagtacttcttcgaccgcagctcgcaggcgttccgatatgtcctgcactactaccgcaccggccgcctgcatgtcatggagcagctgtgcgcgctctccttcctgcaggagatccagtactggggcatcgatgagctcagcatcgattcctgctgcagggacagatacttcagaaggaaagagctgagtgaaactttagacttcaagaaggacacagaagaccaggaaagtcaacatgagagtgaacaggacttctcccaaggaccttgtcccactgttcgccagaagctctggaatatcctggagaaacctggatcttccacagctgcccgtatctttggcgtcatctccattatcttcgtggtggtgtccatcattaacatggccctgatgtcagctgagttaagctggctggacctgcagctgctggaaatcctggagtatgtgtgcattagctggttcaccggggagtttgtcctccgcttcctgtgtgtgcgggacaggtgtcgcttcctaagaaaggattacgctcccttgggatgacaatcacccagtgttacgaagaagtcggcctactgctcctatttctatccgtgggaatctctatattttcaactgtagaatactttgctgagcaaagcattcctgacacaaccttcacaagtgtcccttgtgcatggtggtgggccaccacctctatgactactgtgggatatggggacattagaccagacaccaccacaggcaaaatcgtggccttcatgtgtatattatcgggaattcttgtcttggccttgcctattgctattattaacgatcgcttctctgcttgctacttcaccttgaaactcaaggaagcagctgttagacagcgtgaagccctaaagaagcttaccaagaatatagccactgactcatatatcagtgttaacttgagagatgtctatgcccggagtatcatggagatgctgcgactgaaaggcagagaaagagcaagtactaggagcagcgggggagatgatttctggttttgaattaattttcaatttatttacaaaagctatgtacaattaactaaaatgataaagcagtgatgtggatttctgtattctgatgatgagtctcttcagagtactgctcatcttaattaatttttgctgatatattgcttcatctactagaatatttcacatcacctataacaactgcacagtgttctgacacatttgagtgtccaaaatagccaattaacacaaccaaatacaactgggccaatataaacatgtttgaattgtcaaatataaaataatgttattgcaatacatacaaaaaagttaaagattttatgtatcactaacattagaagttttttgcaccactaattttttaaaaatggaaggtaaactgcatagcccagagaaagataagtaaatatttaagaacatattgaacaactttgctatttaaagatattatccaagtacataaattactccgttctctatcagttaaagctattgaatataatacttagctttacaagagaaaacccatatttgatgggcagagattatatccctatcttctttttcatgtaaaccactggtcacaaatgaactgatctctgtatcccattattactataagaggtgggaatcccaaaactgcttagattgcagtacatgagtctacacaaagacttcaacaattgcacatcttcattctcccaactgagtgtagtatgtggagcataaaacagcatatttcttagtatttcatgaatatcagatggtctttaaatgtctctttatggatgtattgttcacattatggctttaaaataatgaatatgtaaaagtgaggtagtgaacatcctaaatttctacactggaattactaaataatcttatttcataaaatgggaaatatatgttaaatgacatcactggatgaacttgaagatcttttacttgttaacaaaaaaatactatggacagctttctgattgttggggtaaatagcaaatgttcaaactttgcaggcattttgacattcatcataacaacacaattcctagacattgtattatataattaaagccaaaacctctaaagctaagaactagctcatgattcccattattttagtaaatgagattctacaacctaagaataacaaggaatgcatcactttaatacctacatttccaatataatagagcccccaaggggaagaaaattggttcttgaggaaaaaaaaatcttatcacttcatttacaaaacacagataagcatattgagtatatctgtggtattaacatttcatgggggtgagatgttagggaaaaaagcctagaaggctctttgccaggggtgaatggtgataagaaat

SEQ ID NO: 733594 - DNA, 2754 bp, Homo sapiens; identical to SEQ ID NO: 69162

SEQ ID NO: 733595 - DNA, 1291 bp, Homo sapiens; identical to SEQ ID NO: 358637
  misc_feature (1288)..(1288): n is a, c, g, or t
  misc_feature (1291)..(1291): n is a, c, g, or t

SEQ ID NO: 733596 - DNA, 1423 bp, Homo sapiens; identical to SEQ ID NO: 358638

SEQ ID NO: 733597 - DNA, 1228 bp, Homo sapiens; identical to SEQ ID NO: 358639
  misc_feature (1225)..(1225): n is a, c, g, or t
  misc_feature (1228)..(1228): n is a, c, g, or t

SEQ ID NO: 733598 - DNA, 1360 bp, Homo sapiens
gccgccgctgccgctgccgccgccggcccggactcgtccggagcgcagggtgtctgcccagctgcgcgcggcgcgcggaggctccggcgtccgccgctgcgccctccggcccctgctcctcgcgccggcccgcgtgggtcccggcgggcgcgaacccaccatgcagctgcagttccggagctggatgctggccgcgctcacgctgctcgtggtcttcctcatcttcgcagacatctcagagatcgaagaagaaatcggagctgaagttgtaataaacggctcctcatcaccagctgttgttgacagaagtaatgaaagcatcaagcacaacatccagccagcctcgtccaaatggagacataaccagacgctctctctgaggatcaggaagcagattttaaagttcttggatgctgaaaaggacatttctgtcctaaagggaaccctgaagcctggagatattattcattacatcttcgatcgagacagcaccatgaatgtgtcccagaacctctacgagctcctccccaggacttcgccactgaagaataagcactttgggacttgtgccatcgtgggcaactcgggggtcttgctgaacagcggctgtgggcaggagattgacgcccacagcttcgtcatcaggtgcaacctggccccagtacaggagtatgcccgggatgtggggctcaagacagacctggtaaccatgaacccctcggtcatccagcgggcctttgaggacttggtcaatgccacgtggcgggagaagctgctgcaacggctgcacagcctcaatggcagcatcctgtggatccctgccttcatggcccggggcggcaaggagcgtgttgagtgggtcaacgagcttatcctgaagcaccacgtcaacgtgcgcactgcatacccctcgctgcgcctgctgcacgccgttcgcggatactggctgaccaacaaagtccacatcaaaagacccaccaccggcctcttgatgtataccctggccacacgtttctgcaaacaaatctacctctacggcattcctgaccactagaactgtgcttggcacagagtaggcacttaataaactcctgctgcatgaacaaaagaacaagtgtggatgcttcaaaggaagacttgcacccggctgacccccagagtggggaaggggtcccacctaataggaagaacaccaagacttccccaagaggagaaggaacggctccccctttctcggcgaggccatgtgtctggaccctgtgtgagatgctttctatactagcccttgttggggtgttgcacccattttacagatcaaacaaccaagtttatcagaaattaaagactcatttaagatgcc

SEQ ID NO: 733599 - DNA, 2523 bp, Homo sapiens; identical to SEQ ID NO: 414127

SEQ ID NO: 733600 - DNA, 3267 bp, Homo sapiens
agcgggtcagttaactgttcctacaaatgaaagacacaagccaataaagccagtgagaaaggagcttaccaaaggcagtgtacgaagaaggttcctgggagactgtcagaaatgagtttttcactgaacttcaccctgccggcgaacacaacgtcctctcctgtcacaggtgggaaagaaacggactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgcccagactgagcctggaatgatgcagctcagtcaaggagcagcagacctggcactggaacagggttgaaaacccagggttttgtacttggagaggaaagatgccaagctgcttcttaatcaatccaaatttcatttacagctctggaacactttggggctgatttgtctctttaggggacatccccaacatggttaattccaactctcagatcttgtgctttagttagtacatgtgactcaccagatggggtccttagatcctattcctgctcccagtgggaatttgcttttctttgtcattttgggaaaggggcttggtttctgagtgtcttgccttctcatctttttttttcatatcctttttctcaaaaaagccatcagatctgactttcatggaagtgttgctgaggtcagcctggtgcaagttgggatacaaatgaaacttatgcaggatgtgtgagaggaagcagttaattgtttctgaatatctcagggtaggaaccatgtggagccacacattccctgaccacagggaagcacctggctcaatcatgtcacacagcagtggaaagaatacggactcttaagtcacacctaccactgagcagctgtacgactttggagaagttgtttaacattttcaagcctcagtttttgcttttttaaaggaggggaaatatttgcctcatgtcataattgaaaagattaaataagaaataaagggaagtgtctgctacttagttgccagtcaaaatgttagttctctctctctaccaccttcctcctacctcttcccatattgcttgcctgataaaacagctaatcaccagcatttgttccccatagtcacagggccacacaagggaacatttaggacaaactttctccatggcctatgatccaaattgttatctaaagatgattctaggtgttgctggtagtatgtgaatcttccaatctaggtgtgatcgtgtcctcatatgaatcaggaaaaggcagtttcttacaagttccgaattccaaatacagagactggtggtgttacatttaaccttaaagatgttaatgttgatggaaattcatgtttcatattaaaacaacactttgtctttacaatgaaacattttgcttaatttttaaagtaagacattatgatacctctgatggcagttcctcaaataactttaacttttgtgctttagggatagttgttaaagttacaacttcttttattttattttttaaaggcttcagattaaacaagagcccttaagcccacgcatagcattgccgcttcagcttgctgaggactgtctccaaggaggccaaatggaaaaggagaggctacttcaagtggtgttggcccattgagcctattgggcaaactataaccaggttgccttattttgggtggattactccaggagaggccaccctccagctttctcttatcccagtaactcctcttcccattttccaatccatccccagccattttttttttttcttctgtactcttcttttgccttcaatatgagtttcatttcctctgtgtctttgggcagacttccttctaacatgtgtcagctaccctaccacacacctggcctaggagacacatcattcattgctcctacttgtgtctgtaatcagagagtatttaaggagggcagttctgcgacggactgtgtgtgtgttgaaagtaaagatggggggccgcggggaaggcaagagtttttccaaaagattattagaaatgagggctgtatctactctgtggagtagaaccaagtctacttggagaaaagaaccaagtccttgggatatctaggggaaagctgtttggcagaaagaaaaatcaagaggacccaaggggatggagacaggaccacaggaatgggccaaggagcaacgtgcctgccattcagccagcttgggacaggctttcactttcactcccatgaggaggcttccaggcagcctggttcccccatgtatagccattgccctctagcaggccaggcctcccagtgggaaggcctgggtccagggcatcttaagttcatccagcagctccatgagccacacagatatcctagaaaatattcctttctcacacagggcttctgattactcagaaacatgcccctcttccctgaataaccaagaacatgttctatgaacccaatctctgccacatgtcaatacctgctcttcaaagccccttttgaaactcagttttgtgccaagtcctctggatctaattaccttaaacaagcagatttagccatttttaaacagacattcccagtcatcctggtgcttgtacttctcctacatgtcatgaaggaccttggatttactgagaactcagccgtggccttggctttgatacttataggtgtcagcccttgggccgattgttgatcatccagagcctcagttctgtacttgtaaagtggagacagcagttctcatcctccatccttttagcccatggggtggttgtaaggctggattgaaatatgcatgtgactaagccatgtagctataaagtgagggatgacttgtgttttggatcacttattttaattctacttataatccacggcttagaatatttaaacattgtttctattaaactagaaaggttcagcatttctgtcatttacttctgctatgatacacaagaacttatgttggaatgaagtgaaaagtaaaatggccattcttatgaacctacaaaaaaa

SEQ ID NO: 733601 - DNA, 229 bp, Homo sapiens
gacgtccccacccaccccgtcctccaggttctacgcggcagaaatcgctatcggcctcttcttccttcacaatcagggcatcatctacagggacctgaagctggacaatgtgatgctggatgctgagggacacatcaagatcactgactttggcatgtgtaaggagaacgtcttccccgggacgacaacccgcaccttctgcgggaccccggactacatagccccggag

SEQ ID NO: 733602 - DNA, 1917 bp, Homo sapiens
caggctgcgagatgaacgtgcaccggcgctgtgtgcgtagcgtgccctccctgtgcggtgtggaccacaccgagcgccgcgggcgcctgcagctggagatccgggctcccacagcagatgagatccacgtaactgttggcgaggcccgtaacctaattcctatggaccccaatggtctctctgatccctatgtgaaactgaagctcatcccagaccctcggaacctgacgaaacagaagacccgaacggtgaaagccacgctaaaccctgtgtggaatgagacctttgtgttcaacctgaagccaggggatgtggagcgccggctcagcgtggaggtgtgggactgggaccggacctcccgcaacgacttcatgggggccatgtcctttggcgtctcggagctgctcaaggcgcccgtggatggctggtacaagttactgaaccaggaggagggcgagtattacaatgtgccggtggccgatgctgacaactgcagcctcctccagaagtttgaggcttgtaactaccccctggaattgtatgagcgggtgcggatgggcccctcttcctctcccatcccctccccttcccctagtcccaccgaccccaagcgctgcttcttcggggcgagtccaggacgcctgcacatctccgacttcagcttcctcatggttctaggaaaaggcagttttgggaaggtgatgctggccgagcgcaggggctctgatgagctctacgccatcaagatcttgaaaaaggacgtgatcgtccaggacgacgatgtggactgcacgctggtggagaaacgtgtgctggcgctggggggccggggtcctggcggccggccccacttcctcacccagctccactccaccttccagaccccggaccgcctgtatttcgtgatggagtacgtcaccgggggagacttgatgtaccacattcaacagctgggcaagtttaaggagccccatgcagcgttctacgcggcagaaatcgctatcggcctcttcttccttcacaatcagggcatcatctacagggacctgaagctggacaatgtgatgctggatgctgagggacacatcaagatcactgactttggcatgtgtaaggagaacgtcttccccgggacgacaacccgcaccttctgcgggaccccggactacatagccccggagatcattgcctaccagccctatgggaagtctgtcgattggtggtcctttggagttctgctgtatgagatgttggcaggacagcctcccttcgatggggaggacgaggaggagctgtttcaggccatcatggaacaaactgtcacctaccccaagtcgctttcccgggaagccgtggccatctgcaaggggttcctgaccaagcacccagggaagcgcctgggctcagggcctgatggggaacctaccatccgtgcacatggctttttccgctggattgactgggagcggctggaacgattggagatcccgcctcctttcagaccccgcccgtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatgtaatctcacccgccgccactaggtgtccccaacgtcccctccgccgtgccggcggcagccccacttcacccccaacttcaccaccccctgtcccattctagatcctgcaccccagcattccagctctgcccccgcgggttctagacgcccctcccaagcgttcctggccttctgaactccatacagcctctacagccgtcccgcgttcaagacttgagcg

SEQ ID NO: 733603 - DNA, 3002 bp, Homo sapiens
cagcagctgcctgggtgaagcatctgctggacaagtcggaccactggccaggggacctttgattgtctttccagagatgctgctctctgcagggcaccaccttcaaggcacagcccttgttgggagggagaaccctctccagaaaccctgccaccatggtgtcttgccgtacttcccacagccgcctttttgcggcctggccggccaggcttcccgtgcgttatacacagagtttgggcacacactgccctccctccgagatgccagaagtttttccacagccttggagaggggctttgactgagggctgggggccctgggctccgtttccttcacattccagctggcccggatccctctgtggcacagggccctgcccgtcacatgccctctgggtgacatcggagcagacctccatgtggccaggggttgggagaactttacaaacattaggacctaacactgtctcatcgctgaaataagaggccatagcaccgaaaagcagcgtgggcgccggctgaggcttctcccagcccgtgggtggcagcgtgctagcacactgccaccatctcaaagccatccccctagccatcgtgagcatcccagcggcaccgccattgtctcaaccagccggctcctcgtctgtacacctggggatttcttttgatttcaagaacagccttaatcattccagtttgatttacgtgtatacctcataaacatttttcttttgtttctctctccccctttctctcttctcttggctcactcccttgcctctccccctccaccaccaccttgtgactgatggtttggtttcctctctgctctgcccctgctcagcacagggagaatgttgacttagaagcaatagggggcagcaggccaccaagagcacaaccccagggcgaggtctggggaggcctcccagcccgcctctgtttactgtgcaattccagtcgttcttaagccatcaccagtgggtgtactcagagcagaggggccaggacttctgccagccaagggaaaggcccagagccctgtgcgggggaatgtggcactgtctatccatccggtggactgggcagcattcctccccagggctcttcccttgggggcctcctttcatctggggcacagccacaagtctcatctctaacgttctatgcaatgaaatataaaccctcaatgacaactgttaatatttaataaattccatgttatgtataaggagttaattgcaaacatgcaattgagaaactggatagatacactcataaaacccccacccctccccaccccacccctgctcccattgtgtgtgtgaaattctcagtctgtggcatgtttgacctgtggcaggactcgctgctgccaggtgagtcaccgcctgtcctgcagtggagcatgcacagctcgcagcctctttgcacgatttcatccattttaaatgcttgaccctcttgcttggagttctttttgcctcagaacctctccttcaggagcacttctagctgacttctgcacaagctagtgaggacctgccagaattgttgcctgagcgtgccaggctgcagggcaggcagtaaaaggcccccacataccctgcagttttctctgtccaggacagcaggtaaaaaggaatccccagagcagacgcaatggtaggagcctgcacaggatgtgtgtgtatggacattctgaaggtttgctgtaggatatctgtctgtctgtcattttcccttcctaccccaaccctgagccagaggcatctgacagccctttcccagagggcaccacgcaagggcagagctgggcggcatccacagccagagaggcagaggcaagagcagagccaggctgtgcccgagggaccccagctcttgactgcacctgtttcatgcctctcctctgtggctaggaggctcaaaggactgtgagccaggagatctgggctggagctagggggtcaatggatgctcaggaagagctgggcctttggcacttgtggtgagaacagttgacagtggtcatctggaactgttcatataaacagtggcttcaagctaagtttcttgtgaagtttctcaatagcaaatcttacagaaggtcctgtgtgaccctctctgcatctgtccccaggacctatgctccctgctcacccccttctccaaagcccaagcgtcccgctgctcatcagcttttttaccattgagccaggagtgcggcaggcagtacctgcctgacccttcaaggcctgaccttcgtccagagtgctctggtttgcaccatgcatttctcaggggtccgcatttctcatgcttttctataagatctacacaccccttcagagagggctcctcgctcacctctggtagctatggatgggacaggaagctgccaacctttgtgttggacttaacacccttgcctttctgggacttggcctcaccccacccatggaatacctgcctcatcccaaagatcaggtatgggctgaatgcagccatctgagcaagggctgagggaagccatcatctaacacctctggccacccaggaccaggtctgtgtggggatgtgccttggagaccaaggcaatagtcctttccactacaggccaggggatgggacaagaagtagggaacaggcagggaaatgttaggaggtcagcctccagcaggcctagtctcaggctctaaagtactgacttttcagcaaatttcctttctggccaagccctctgagtttgaaattctgacatctgccactcctcatcccccactgtacccacaggatacatcatcgcccctctgtgaaggtggctggagcaggcctctggtccatggactgtccttcctggcccttgcatggatgcagttgtgactctggggacaatgcagccagaagctgagggaccagcacttggtgccttggaaagtagagagcaacagacacatctccaaatgggcaaggagtctctagcatgcagcccaggccttc

SEQ ID NO: 733604 - DNA, 2102 bp, Homo sapiens
  misc_feature (70)..(70): n is a, c, g, or t
cagtttctcaattgcatgtttgcaattaactccttatacataacatggaatttattaaatattaacagtngtcattgagggtttatatttcattgcagaggggccaggacttctgccagccaagggaaaggcccagagccctgtgcgggggaatgtggcactgtctatccatccggtggactgggcagcattcctccccagggctcttcccttgggggcctcctttcatctggggcacagccacaagtctcatctctaacgttctatgcaatgaaatataaaccctcaatgacaactgttaatatttaataaattccatgttatgtataaggagttaattgcaaacatgcaattgagaaactggatagatacactcataaaacccccacccctccccaccccacccctgctcccattgtgtgtgtgaaattctcagtctgtggcatgtttgacctgtggcaggactcgctgctgccaggtgagtcaccgcctgtcctgcagtggagcatgcacagctcgcagcctctttgcacgatttcatccattttaaatgcttgaccctcttgcttggagttctttttgcctcagaacctctccttcaggagcacttctagctgacttctgcacaagctagtgaggacctgccagaattgttgcctgagcgtgccaggctgcagggcaggcagtaaaaggcccccacataccctgcagttttctctgtccaggacagcaggtaaaaaggaatccccagagcagacgcaatggtaggagcctgcacaggatgtgtgtgtatggacattctgaaggtttgctgtaggatatctgtctgtctgtcattttcccttcctaccccaaccctgagccagaggcatctgacagccctttcccagagggcaccacgcaagggcagagctgggcggcatccacagccagagaggcagaggcaagagcagagccaggctgtgcccgagggaccccagctcttgactgcacctgtttcatgcctctcctctgtggctaggaggctcaaaggactgtgagccaggagatctgggctggagctagggggtcaatggatgctcaggaagagctgggcctttggcacttgtggtgagaacagttgacagtggtcatctggaactgttcatataaacagtggcttcaagctaagtttcttgtgaagtttctcaatagcaaatcttacagaaggtcctgtgtgaccctctctgcatctgtccccaggacctatgctccctgctcacccccttctccaaagcccaagcgtcccgctgctcatcagcttttttaccattgagccaggagtgcggcaggcagtacctgcctgacccttcaaggcctgaccttcgtccagagtgctctggtttgcaccatgcatttctcaggggtccgcatttctcatgcttttctataagatctacacaccccttcagagagggctcctcgctcacctctggtagctatggatgggacaggaagctgccaacctttgtgttggacttaacacccttgcctttctgggacttggcctcaccccacccatggaatacctgcctcatcccaaagatcaggtatgggctgaatgcagccatctgagcaagggctgagggaagccatcatctaacacctctggccacccaggaccaggtctgtgtggggatgtgccttggagaccaaggcaatagtcctttccactacaggccaggggatgggacaagaagtagggaacaggcagggaaatgttaggaggtcagcctccagcaggcctagtctcaggctctaaagtactgacttttcagcaaatttcctttctggccaagccctctgagtttgaaattctgacatctgccactcctcatcccccactgtacccacaggatacatcatcgcccctctgtgaaggtggctggagcaggcctctggtccatggactgtccttcctggcccttgcatggatgcagttgtgactctggggacaatgcagccagaagctgagggaccagcacttggtgccttggaaagtagagagcaacagacacatctccaaatgggcaaggagtctctagcatgcagcccaggccttc

SEQ ID NO: 733605 - DNA, 1340 bp, Homo sapiens
  misc_feature (70)..(70): n is a, c, g, or t
cagtttctcaattgcatgtttgcaattaactccttatacataacatggaatttattaaatattaacagtngtcattgagggtttatatttcattgcagaggggccaggacttctgccagccaagggaaaggcccagagccctgtgcgggggaatgtggcactgtctatccatccggtggactgggcagcattcctccccagggctcttcccttgggggcctcctttcatctggggcacagccacaagtctcatctctaacgttctatgcaatgaaatataaaccctcaatgacaactgttaatatttaataaattccatgttatgtataaggagttaattgcaaacatgcaattgagaaactggatagatacactcataaaacccccacccctccccaccccacccctgctcccattgtgtgtgtgaaattctcagtctgtggcatgtttgacctgtggcaggactcgctgctgccaggtgagtcaccgcctgtcctgcagtggagcatgcacagctcgcagcctctttgcacgatttcatccattttaaatgcttgaccctcttgcttggagttctttttgcctcagaacctctccttcaggagcacttctagctgacttctgcacaagctagtgaggacctgccagaattgttgcctgagcgtgccaggctgcagggcaggcagtaaaaggcccccacataccctgcagttttctctgtccaggacagcaggtaaaaaggaatccccagagcagacgcaatggtaggagcctgcacaggatgtgtgtgtatggacattctgaaggtttgctgtaggatatctgtctgtctgtcattttcccttcctaccccaaccctgagccagaggcatctgacagccctttcccagagggcaccacgcaagggcagagctgggcggcatccacagccagagaggcagaggcaagagcagagccaggctgtgcccgagggaccccagctcttgactgcacctgtttcatgcctctcctctgtggctaggagggtctcaggctctaaagtactgacttttcagcaaatttcctttctggccaagccctctgagtttgaaattctgacatctgccactcctcatcccccactgtacccacaggatacatcatcgcccctctgtgaaggtggctggagcaggcctctggtccatggactgtccttcctggcccttgcatggatgcagttgtgactctggggacaatgcagccagaagctgagggaccagcacttggtgccttggaaagtagagagcaacagacacatctccaaatgggcaaggagtctctagcatgcagcccaggccttc

SEQ ID NO: 733606 - DNA, 2240 bp, Homo sapiens
cagcagctgcctgggtgaagcatctgctggacaagtcggaccactggccaggggacctttgattgtctttccagagatgctgctctctgcagggcaccaccttcaaggcacagcccttgttgggagggagaaccctctccagaaaccctgccaccatggtgtcttgccgtacttcccacagccgcctttttgcggcctggccggccaggcttcccgtgcgttatacacagagtttgggcacacactgccctccctccgagatgccagaagtttttccacagccttggagaggggctttgactgagggctgggggccctgggctccgtttccttcacattccagctggcccggatccctctgtggcacagggccctgcccgtcacatgccctctgggtgacatcggagcagacctccatgtggccaggggttgggagaactttacaaacattaggacctaacactgtctcatcgctgaaataagaggccatagcaccgaaaagcagcgtgggcgccggctgaggcttctcccagcccgtgggtggcagcgtgctagcacactgccaccatctcaaagccatccccctagccatcgtgagcatcccagcggcaccgccattgtctcaaccagccggctcctcgtctgtacacctggggatttcttttgatttcaagaacagccttaatcattccagtttgatttacgtgtatacctcataaacatttttcttttgtttctctctccccctttctctcttctcttggctcactcccttgcctctccccctccaccaccaccttgtgactgatggtttggtttcctctctgctctgcccctgctcagcacagggagaatgttgacttagaagcaatagggggcagcaggccaccaagagcacaaccccagggcgaggtctggggaggcctcccagcccgcctctgtttactgtgcaattccagtcgttcttaagccatcaccagtgggtgtactcagagcagaggggccaggacttctgccagccaagggaaaggcccagagccctgtgcgggggaatgtggcactgtctatccatccggtggactgggcagcattcctccccagggctcttcccttgggggcctcctttcatctggggcacagccacaagtctcatctctaacgttctatgcaatgaaatataaaccctcaatgacaactgttaatatttaataaattccatgttatgtataaggagttaattgcaaacatgcaattgagaaactggatagatacactcataaaacccccacccctccccaccccacccctgctcccattgtgtgtgtgaaattctcagtctgtggcatgtttgacctgtggcaggactcgctgctgccaggtgagtcaccgcctgtcctgcagtggagcatgcacagctcgcagcctctttgcacgatttcatccattttaaatgcttgaccctcttgcttggagttctttttgcctcagaacctctccttcaggagcacttctagctgacttctgcacaagctagtgaggacctgccagaattgttgcctgagcgtgccaggctgcagggcaggcagtaaaaggcccccacataccctgcagttttctctgtccaggacagcaggtaaaaaggaatccccagagcagacgcaatggtaggagcctgcacaggatgtgtgtgtatggacattctgaaggtttgctgtaggatatctgtctgtctgtcattttcccttcctaccccaaccctgagccagaggcatctgacagccctttcccagagggcaccacgcaagggcagagctgggcggcatccacagccagagaggcagaggcaagagcagagccaggctgtgcccgagggaccccagctcttgactgcacctgtttcatgcctctcctctgtggctaggagggtctcaggctctaaagtactgacttttcagcaaatttcctttctggccaagccctctgagtttgaaattctgacatctgccactcctcatcccccactgtacccacaggatacatcatcgcccctctgtgaaggtggctggagcaggcctctggtccatggactgtccttcctggcccttgcatggatgcagttgtgactctggggacaatgcagccagaagctgagggaccagcacttggtgccttggaaagtagagagcaacagacacatctccaaatgggcaaggagtctctagcatgcagcccaggccttc

SEQ ID NO: 733607 - DNA, 2950 bp, Homo sapiens
gagcgggctgcctccttccccccgagcggagctgcggggcctggccgggccgggtgcggaccccgggaacccggacgcggcgcccgggcccgcgggcggggggatcggcgggggggacccgcggggtgaccggcggcaggagccgccaccatggagttccgccaggaggagtttcggaagctagcgggtcgtgctctcgggaagctgcaccgccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccatgaaagggaatggggcaggagacaggggtgttttttcccagtgcagggttgtgtctttgtgtctctgtctctgtgactgtaaatcctgccctgccccactcccaataaaagctttggtgtatagg

SEQ ID NO: 733608 - DNA, 2852 bp, Homo sapiens
gagcgggctgcctccttccccccgagcggagctgcggggcctggccgggccgggtgcggaccccgggaacccggacgcggcgcccgggcccgcgggcggggggatcggcgggggggacccgcggggtgaccggcggcaggagccgccaccatggagttccgccaggaggagtttcggaagctagcgggtcgtgctctcgggaagctgcaccgccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccactcccaataaaagctttggtgtatagg

SEQ ID NO: 733609 - DNA, 1179 bp, Homo sapiens
gcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagacccaggagcctatgtgtagacct

SEQ ID NO: 733610 - DNA, 924 bp, Homo sapiens
  misc_feature (4)..(5): n is a, c, g, or t
  misc_feature (18)..(18): n is a, c, g, or t
  misc_feature (447)..(447): n is a, c, g, or t
ttanncaagcttggcacngagggtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaangcacataacccatagtgaaatgtgctggcctctggtgcatttgcaagatgagcacaaactttctgggcctccatcctaggacctgggcagacccacatggctgggctctgaatgcccaccctgcgacggtgggttctgatcagcaaacgctgaggagtgggcagattttctttgtctttgcttgcattttctagatccacacctggatactgccaatgttggaccgatgacaggcagcagggggagagggaggcgaaagggcaaggtgcggtggcaagaaaggaaagcccgggaaaaggccttttaaccttagccgagaacgataacacaaggaccggacattaaagcagagggagagggaccgaagggcgtccaaacaaaaatgttctcccggcccaggaaacaaaaaacaaggtggccaagggcaactttagacgaagggtttgcccccgtaaggaaggacccccaaaacgcaaa

SEQ ID NO: 733611 - DNA, 2355 bp, Homo sapiens
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 733612 - DNA, 385 bp, Homo sapiens
cagctgcgtatgtggcccaggggaggagtgtggtccctctgtgtgcattccctggaatgtggaacttcctagatgccaccctcctcttggagagcagtggctggtcttacttttttattgtactttcagtgtctgccacacagcacaggcccagtgaaagtggaccaagacccagctgcgtacaagtacttgcaggaataagcaggtacctgcatgaatgagcacagagcttgcaggagaggcctggggtatcttggtgcaccaggccacggggtcaaatttacctgccttcctggcaagagatcacaagaaatattcccaggttcacatgtaagaatgtttgctgcagtactatctataaaattaaagtattggaaactagact

SEQ ID NO: 733613 - DNA, 657 bp, Homo sapiens
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 733614 - DNA, 2395 bp, Homo sapiens
  misc_feature (2381)..(2381): n is a, c, g, or t
  misc_feature (2383)..(2383): n is a, c, g, or t
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagaaaaaaaaaaaacagagagagagagananagagagagagag

SEQ ID NO: 733615 - DNA, 2247 bp, Homo sapiens
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaattgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 733616 - DNA, 2287 bp, Homo sapiens
  misc_feature (2273)..(2273): n is a, c, g, or t
  misc_feature (2275)..(2275): n is a, c, g, or t
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaattgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagaaaaaaaaaaaacagagagagagagananagagagagagag

SEQ ID NO: 733617 - DNA, 1984 bp, Homo sapiens
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 733618 - DNA, 2024 bp, Homo sapiens
  misc_feature (2010)..(2010): n is a, c, g, or t
  misc_feature (2012)..(2012): n is a, c, g, or t
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagaaaaaaaaaaaacagagagagagagananagagagagagag

SEQ ID NO: 733619 - DNA, 1702 bp, Homo sapiens
gtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 733620 - DNA, 1742 bp, Homo sapiens
  misc_feature (1728)..(1728): n is a, c, g, or t
  misc_feature (1730)..(1730): n is a, c, g, or t
gtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagaaaaaaaaaaaacagagagagagagananagagagagagag

SEQ ID NO: 733621 - DNA, 694 bp, Homo sapiens
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 733622 - DNA, 2228 bp, Homo sapiens
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccaggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 733623 - DNA, 2268 bp, Homo sapiens
  misc_feature (2254)..(2254): n is a, c, g, or t
  misc_feature (2256)..(2256): n is a, c, g, or t
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccaggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagaaaaaaaaaaaacagagagagagagananagagagagagag

SEQ ID NO: 733624 - DNA, 638 bp, Homo sapiens
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcatgtctgccacacagcacaggcccagtgaaagtggaccaagacccagctgcgtacaagtacttgcaggaataagcaggtacctgcatgaatgagcacagagcttgcaggagaggcctggggtatcttggtgcaccaggccacggggtcaaatttacctgccttcctggcaagagatcacaagaaatattcccaggttcacatgtaagaatgtttgctgcagtactatctataaaattaaagtattggaaactagact

SEQ ID NO: 733625 - DNA, 2410 bp, Homo sapiens
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacaccctctctttctgcctcacctcctgctgtaaccagaatcccactgcttgccttaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 733626 - DNA, 2450 bp, Homo sapiens
  misc_feature (2436)..(2436): n is a, c, g, or t
  misc_feature (2438)..(2438): n is a, c, g, or t
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacaccctctctttctgcctcacctcctgctgtaaccagaatcccactgcttgccttaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagaaaaaaaaaaaacagagagagagagananagagagagagag

SEQ ID NO: 733627 - DNA, 2302 bp, Homo sapiens
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacaccctctctttctgcctcacctcctgctgtaaccagaatcccactgcttgccttaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaattgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 733628 - DNA, 2342 bp, Homo sapiens
  misc_feature (2328)..(2328): n is a, c, g, or t
  misc_feature (2330)..(2330): n is a, c, g, or t
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacaccctctctttctgcctcacctcctgctgtaaccagaatcccactgcttgccttaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaattgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagaaaaaaaaaaaacagagagagagagananagagagagagag

SEQ ID NO: 733629 - DNA, 2283 bp, Homo sapiens
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacaccctctctttctgcctcacctcctgctgtaaccagaatcccactgcttgccttaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccaggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 733630 - DNA, 2323 bp, Homo sapiens
  misc_feature (2309)..(2309): n is a, c, g, or t
  misc_feature (2311)..(2311): n is a, c, g, or t
agcgcagaagctccgatccagacacacgcgaggcgctgtcctttcagcaccacaagctcgggctgaggagggaggactcctggccgtcctcctcctcttcaaattggcttgaatctgctctgaccccccacgagtgcagcacaccctctctttctgcctcacctcctgctgtaaccagaatcccactgcttgccttaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccaggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagaaaaaaaaaaaacagagagagagagananagagagagagag

SEQ ID NO: 733631 - DNA, 516 bp, Homo sapiens
  misc_feature (471)..(471): n is a, c, g, or t
tacttttcacagggacagcatgaccacagagaacggcaagatcagcaccacggatgtacccatgggtcagcataattttcaaaatcgcaccttaagaaccaagtcacaaaagaagagatttgaagaagaattgaatgaaaggatgattcaagcaattgatgggattaatgcacagaagcaatggctcaagtctgaagacattcagagaatctcactgcttttctataacaaagtactagaaaaagagtaccgggccacggcactgccagcgttcaagtattatgtgacttgtgcctgtctcatattcttctgcatcttcattgtgcagattctcgtgctgccaaaaacgtccgtcctgggcatctcctttggggctgcgtttctcttgctggccttcatcctcttcgtctgctttgctggacagctctgcaatgcagcaaaaaagcctctcccctgctcatgtggcttttnaagtcctcgggcatcattgccaaccggccctgggcacggatctct

SEQ ID NO: 733632 - DNA, 555 bp, Homo sapiens
agcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaaggtagagaaaggatgaagacccccaccccagcctcccctcactccatgaaagcccgtgatgcccaatcatgcggtggtctgcctctgtgtgtttctgtgtgtgtctgtgtgtgtatagtctgcatgtgtctgtttctctgtgtgtctgtgtgtatgtcgatgtgcctgcatatgtctgtgtgtgtgtgtatctgtgtatgtctgtatttgtgtctctgtgtgtctgtgtgtctgtgtgtgtctcagtgtgtgtctgtgtctttgtgtgtctctgtgtatctgtgtgtgtgtctgtgtgtctccgtgtctctgtgtgtgtgtgtatggcctgtgtgtgtctgtgtgtgtgcacgtatgcgtccatgtgggtgtttgtgcgtgcatgtctgtgtctgtctctgtgtgtgt

SEQ ID NO: 733633 - DNA, 723 bp, Homo sapiens
agcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaagccttcctgtgcatcggtggatctgcagggagacagctccttacaggtggagatttctgacgcagtgagtgagcgggacaaggtgaaattcactgttcaaacaaagagctgcctccctcacttcgcccagaccgagttctcagtcgtgcggcagcacgaggagttcatctggctgcatgatgcctacgtggagaatgaggagtacgccggcctcatcatccccccagcccctccgaggccagactttgaggcttcgagggaaaagctacagaaattgggcgagggggacagctctgtcactcgggaagagtttgccaagatgaagcaggagctggaagcggagtacctggccatctttaagaagacagttgcgatgcacgaagtctttctgcagcgcctggcggcccaccccaccctgcgtcgagaccacaacttctttgtgtttttggaatatggacaggatctgagtgtccgggggaagaacaggaaggagctcctcggagggtttctgaggaatattgtgaagtccgcggatgaagccctcatcacgggcatgtcagggctcaaggtaacccc

SEQ ID NO: 733634 - DNA, 2076 bp, Homo sapiens; identical to SEQ ID NO: 318923

SEQ ID NO: 733635 - DNA, 1107 bp, Homo sapiens
cagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcagcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacagg

SEQ ID NO: 733636 - DNA, 598 bp, Homo sapiens
cagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcagcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagacatgggagtggtgagccggaactgcacggaggatggctggtcggaacccttccctcattactttgatgcctgtgggtttgatgaatatgaatctgagactggggaccag

SEQ ID NO: 733637 - DNA, 721 bp, Homo sapiens
ctctcaggcacagaggccaccgttactcctgatgattctgtctcagacccaacaacctggccttcccaggaggtctccatgtgtcaccccctccctgggtctcacccttctcacctgctcaaggaagggatgacctcagtgaggcccagggcctgcagcaaggccctccctggcaattgcagaccaaggattctgctcctccaccttgaactccagcctctttctctccatttttccctctctctcccctacccgtctctccctctctctcacacacacactcttccgggttcaagggccaagcgtctgcctaggctgagacacgtgctgagctccctgaagatggaccagctgccccctagaagggagactttcaggggcatcagggcccttgggatgctccgccctgaccagctttttggtggcagagggaggcacggggagagggagaggccatgtcgcagtccccctgccgtgggagaggcaacgcggaaatgtatagacccagtgctcagccagaaacagggccagcaagcggcagtgaacggaggcagcccggggctcgtcagggtgggcagagccatggcccaggggttgaaaacccccgagttccccgtgagacttggctggcccttcccacccctgggcctcagtctccccatcttgtgtgatgaggagagaccctgaggacagaggtcttcaggctgtgggtctcaacagg

SEQ ID NO: 733638 - DNA, 3101 bp, Homo sapiens
agcggcttctctgcctctctctcctccacgctgctttgatttcgctcttgcctctcttcttgcgctgctcagctgggaacatcgtctcaccaggggcagcagcgacgcgctgcacagccagacaggagctggttgcggggcatggaagcagcctccttggcagccgggagaggagcaagcgcacgccactgcccgtgacccaggcgtccggctgctgtcccctgccggggagctcatccacgcagaggtctctccctgtcctccctgcgagcttttcctctgcagagcccagtggagccagccatgtaccgcggcaacgcttgctgaccccagtgaggagagaggcctgaatccgagggccctggcacctgtgagctcttggctgtcacctgccccaagcctcgcacctccgctccacagcagtccccacaggagacaaccctgacgggagcatggagctgctgtccacgccccacagcattgagatcaacaacatcacctgcgactccttccgcatctcctgggccatggaggacagtgacctggagagggtcacccattacttcattgaccttaacaagaaggagaataagaattccaacaagttcaagcaccgggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgcaggccgcatgctccgcttctccgtcttctaccgcaaccatcacaaggagtacttccagcatgccaggacccactgcgggaacatgctgcagccttacctgaaggacaacagcggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctgggcaccctgggggagatcagtgggcaccagctcatgagtctgtctactgccgatgccaagaaggaccccagctgcaagacctgcaacatcagcgtgggccgctagggactcctggggagctggggggcgagggagagatgagcggaaggtggaggtgggtagcccaggttcagggagctggctttctctctcctgcccccctgctccctccactctgcccagctgccctcccctcgccccttggcattggaggcaacagacggtggtcctcttggtaagtgtggcccacacccagcctggtggacatggaaaggcttctcagcctctgtagttggcagctgggctggacttctggagaacttcccctttcctctggtttccttgtcctactgttctttgcctcgtccaggtctctatctcccaaagacctgcccacctcctgggctctcccagggaagcccctctgggccaaagcccatgggtagcttggctgcctccagaagagatgcagagagctgtggggcgatctttcttagtcccactcaccccactcagggccaaccacagaatgccccctccctgctgagctgggtctctggggcttcccactccaggcctggatcccttccttctataaatagtctcctgcaccaccgtgactccctggctgctccttgccccaaagaaccctcttcctgcatgggagagctgtccctccttctccacctgcccaccgggacactccccctgctctctagaaaggaactctctttcttctcttggcactgggggcgtcaggctgtcggatgttccttccttccataccccagcataccttctccttgcttagagtgcaggggtctgagacagcagccactggggttgaggagggggaggagacccctgagacccagaggtgccccttcctcagctgggagtgggccgcctcatgctctgctggggcctggcatggaacgtgagacctgtaagctgtcccgcgggccccggcaccccgcccagctgtgcactttgctcactcgctctgccatggtgccatgactgtactgtgcccatgcgtgacctggactgtggaccctctgctgctccgcctctcccctccccactggctctgtctgctctcctgccaccctgctggccgggagcccctccccggggagttcttggtgaagtccttcccgggcctccttgtgtttttgcctcattcctactgtcacacaggtcacgagggtggactccctacaatcaacaaagcaaacagagagcctgtgggaggggctgacagcagcagccggctgtttgggggatgatggaggtgacatcaggcagaggagagtgcagcctcacagtgactttctcagaggtgacagagatgatggatgagcagctggattttcgtgatgaaggacggaagcagcagcgggccggcaaggccatacctcggtgagggacaggtggacaacggtcacctatctgtagccaggggcagttgtgtggccagctgtctctctgggatgagtcaggaggcctggaggcttggggagaggtgtggagaaggagagaacatggcccaggccctttccttccccctgtgctgacagcattgctgtgggggtggcccactgccctcccctggccctcatgtccccccggggctggggtccgcctgcctgtgctgtgcttgcgacgtgcatcaataaaccaccatggcctgagggccctgctcgtctcaaaaaaaaaaaa

SEQ ID NO: 733639 - DNA, 2979 bp, Homo sapiens
agcggcttctctgcctctctctcctccacgctgctttgatttcgctcttgcctctcttcttgcgctgctcagctgggaacatcgtctcaccaggggcagcagcgacgcgctgcacagccagacaggagctggttgcggggcatggaagcagcctccttggcagccgggagaggagcaagcgcacgccactgcccgtgacccaggcgtccggctgctgtcccctgccggggagctcatccacgcagaggtctctccctgtcctccctgcgagcttttcctctgcagagcccagtggagccagtccccacaggagacaaccctgacgggagcatggagctgctgtccacgccccacagcattgagatcaacaacatcacctgcgactccttccgcatctcctgggccatggaggacagtgacctggagagggtcacccattacttcattgaccttaacaagaaggagaataagaattccaacaagttcaagcaccgggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgcaggccgcatgctccgcttctccgtcttctaccgcaaccatcacaaggagtacttccagcatgccaggacccactgcgggaacatgctgcagccttacctgaaggacaacagcggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctgggcaccctgggggagatcagtgggcaccagctcatgagtctgtctactgccgatgccaagaaggaccccagctgcaagacctgcaacatcagcgtgggccgctagggactcctggggagctggggggcgagggagagatgagcggaaggtggaggtgggtagcccaggttcagggagctggctttctctctcctgcccccctgctccctccactctgcccagctgccctcccctcgccccttggcattggaggcaacagacggtggtcctcttggtaagtgtggcccacacccagcctggtggacatggaaaggcttctcagcctctgtagttggcagctgggctggacttctggagaacttcccctttcctctggtttccttgtcctactgttctttgcctcgtccaggtctctatctcccaaagacctgcccacctcctgggctctcccagggaagcccctctgggccaaagcccatgggtagcttggctgcctccagaagagatgcagagagctgtggggcgatctttcttagtcccactcaccccactcagggccaaccacagaatgccccctccctgctgagctgggtctctggggcttcccactccaggcctggatcccttccttctataaatagtctcctgcaccaccgtgactccctggctgctccttgccccaaagaaccctcttcctgcatgggagagctgtccctccttctccacctgcccaccgggacactccccctgctctctagaaaggaactctctttcttctcttggcactgggggcgtcaggctgtcggatgttccttccttccataccccagcataccttctccttgcttagagtgcaggggtctgagacagcagccactggggttgaggagggggaggagacccctgagacccagaggtgccccttcctcagctgggagtgggccgcctcatgctctgctggggcctggcatggaacgtgagacctgtaagctgtcccgcgggccccggcaccccgcccagctgtgcactttgctcactcgctctgccatggtgccatgactgtactgtgcccatgcgtgacctggactgtggaccctctgctgctccgcctctcccctccccactggctctgtctgctctcctgccaccctgctggccgggagcccctccccggggagttcttggtgaagtccttcccgggcctccttgtgtttttgcctcattcctactgtcacacaggtcacgagggtggactccctacaatcaacaaagcaaacagagagcctgtgggaggggctgacagcagcagccggctgtttgggggatgatggaggtgacatcaggcagaggagagtgcagcctcacagtgactttctcagaggtgacagagatgatggatgagcagctggattttcgtgatgaaggacggaagcagcagcgggccggcaaggccatacctcggtgagggacaggtggacaacggtcacctatctgtagccaggggcagttgtgtggccagctgtctctctgggatgagtcaggaggcctggaggcttggggagaggtgtggagaaggagagaacatggcccaggccctttccttccccctgtgctgacagcattgctgtgggggtggcccactgccctcccctggccctcatgtccccccggggctggggtccgcctgcctgtgctgtgcttgcgacgtgcatcaataaaccaccatggcctgagggccctgctcgtctcaaaaaaaaaaaa

SEQ ID NO: 733640 - DNA, 2256 bp, Homo sapiens; identical to SEQ ID NO: 716300

SEQ ID NO: 733641 - DNA, 809 bp, Homo sapiens
ggtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtgggaccgcgccgttgagggcgctgagcggggcgcaccatcgccaagcagaaggtgagatcgcggttccaggactcccactctcggggcaaagggccgaggaggcctcacaaggagtccagaaaagccccgagggagggcgcgggattcgcagggatcactggcaaaagaagtcttcccttccttccagacggggaaacgggtggg

SEQ ID NO: 733642 - DNA, 3297 bp, Homo sapiens
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggatgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcacccccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagcatcaaataagagtcttggaaggttgagggtaggggattgttccctacccac

SEQ ID NO: 733643 - DNA, 3249 bp, Homo sapiens
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggatgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcacccccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagcatc

SEQ ID NO: 733644 - DNA, 2455 bp, Homo sapiens
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggatgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcacccccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcagctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagcatc

SEQ ID NO: 733645 - DNA, 2503 bp, Homo sapiens
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggatgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcacccccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcagctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagcatcaaataagagtcttggaaggttgagggtaggggattgttccctacccac

SEQ ID NO: 733646 - DNA, 2889 bp, Homo sapiens
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggatgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcacccccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccaagtttcagacagttctctatgcttaacttatttatttattgcattttacttttaaagagttggtcttttctgtctaaataaagaaaaaagtttaaaagcatc

SEQ ID NO: 733647 - DNA, 318 bp, Homo sapiens
cttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccaagtttcagacagttctctatgcttaacttatttatttattgcattttacttttaaagagttggtcttttctgtctaaataaagaaaaaagtttaaaagcatcaaataagagtcttggaaggttgagggtaggggattgttccctacccac

SEQ ID NO: 733648 - DNA, 2524 bp, Homo sapiens; identical to SEQ ID NO: 318327

SEQ ID NO: 733649 - DNA, 2476 bp, Homo sapiens
tggaggggggaggtttttgttgaggagagcgcggccggagagcagagctccgggacccagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagcatc

SEQ ID NO: 733650 - DNA, 1927 bp, Homo sapiens
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggatgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcacccccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcagctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctagtttcagacagttctctatgcttaacttatttatttattgcattttacttttaaagagttggtcttttctgtctaaataaagaaaaaagtttaaaagcatc

SEQ ID NO: 733651 - DNA, 1359 bp, Homo sapiens; identical to SEQ ID NO: 318330

SEQ ID NO: 733652 - DNA, 1311 bp, Homo sapiens
tctcatgggctatctatttccttcctaataccgtttggtttcctgtatggtttgccccctccctcctgtctcctctatccctgctctcatggctgggggtgggggcagatgggtccgtttggactgaggcctgatgatctgccttcctcaggcagccccatcctagatgctgtcactcaccccagccccctcccctcccccagagcccgtgatccgcatcgggggtctcttccccatgcttcacccatgtttcttccttcacaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagcatc

SEQ ID NO: 733653 - DNA, 2116 bp, Homo sapiens
tggaggggggaggtttttgttgaggagagcgcggccggagagcagagctccgggacccagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccaagtttcagacagttctctatgcttaacttatttatttattgcattttacttttaaagagttggtcttttctgtctaaataaagaaaaaagtttaaaagcatc

SEQ ID NO: 733654 - DNA, 206 bp, Homo sapiens
ccaggtcaagccagccgacagcgagagccgaggaggtaggttctgtgcctttggactctgtccctctcctcccaccccagcccagggcctggagttgtcgaggggtagcctttcttgagggagaaagcctgatgattctgaagagttcccagctgcggtgagataggagtcagtgtggccagagcgggtgagatctggggcgggta

SEQ ID NO: 733655 - DNA, 877 bp, Homo sapiens
ggggtacaggtgcttcctcctgccctgccatcctgggcggggatgatccttcctgttgggctcggccaggaagctgaggtgtagagcagtgaagcgacctgtccagggttgcaagacagtcagacccaagtcttcctaacgctgggctctttcccctcttcccactgctttgtgcatttctgccttctcacttcacaccccatgcccagagaagctctgctccccacctgcctggcctcggcccagaggcccagagaggcactgagggcccccactgtgtgccaggtccacgctcatagtctgtgctgctctccccagcccagagccccgcggcccccgtggaccccctgcagcaggcctacgcggggatgcagcactacacaggtgaggcgccctagccagggcccctgctcaggtgggagaggtggcaggaggaaaagaggcccagtaactgggtctgggcttcttggctccctgccaatcaccctcttcaggctttactgacaagcccaactgtggggaggggtctttaagggcagcacacccaggggtctgaggcagctccttccctgaccacctctcagccctgcaggtgccactggcctgggctaggggaagggagacagggttggctgggagggctcaagaagtcagggaagccccatcagcctctctcttctccccaccccagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggtgctggctggggccttgggagacaggaatgccctcgttatgggcttg

SEQ ID NO: 733656 - DNA, 627 bp, Homo sapiens
ctcctttcctgatctctctgttaagctgcctggctcatttgatatcacatccaaattatcagctgattgctctattgttttggacaatgccctgaagcataccaaaatgtgtctggaattggtgggttcttggtcttactgactttaagaatgaagttgcggacttttgcgtaagaagaaagcccaaagacaaaaccagaggcaactggctgctgcatcgcccacctagtggcagtagtgtgagctatggacaaaagatctaagtctccaggacaaagagttgtgcagctgctcattttcctgttgacttctgtctaagacttggagatgtttgtaagattgggacctacctacagagctccagagggaagtgagaaggatgttcacttgctggtgagagaaggagctggttccatccattacgcagtcccctgggagcgctaaatgcaactttatctcaacggggagtggacgatgagcaggacgtcgctagagggaaagagcctcacttcccgtttcctttggcagcgcccttttcccgacctaagggagcagaccttcgttggttggcgtgaggactggcgggagaggttttgtgccaggatccgcactgtctggggtgaacgc

SEQ ID NO: 733657 - DNA, 509 bp, Homo sapiens
tgcggtgatccaccctaccacatattgtctcctaatggccgtccagtttatcctggagcccttgcatgacacaggcctatcgaagcataggagatgccaatattttacctcttgggtactttctgtgtagaagattcataacaagaacaatacttattctgcaattctttatataaagtaagaagaaagcccaaagacaaaaccagaggcaactggctgctgcatcgcccacctagtggcagtagtgtgagctatggacaaaagatctaagtctccaggacaaagagttgtgcagctgctcattttcctgttgacttctgtctaagacttggagatgtttgtaagattgggacctacctacagagctccagagggaagtgagaaggatgttcacttgctggtgagagaaggagctggttccatccattacgcagtcccctgggagcgctaaatgcaactttatctcaacggggagtggacgatgagcaggacgtcgctagagggaaaga

SEQ ID NO: 733658 - DNA, 1028 bp, Homo sapiens; identical to SEQ ID NO: 458138

SEQ ID NO: 733659 - DNA, 2778 bp, Homo sapiens
ggcacccaccgcagcccagcgcgcgttcgtgctccgcagggcgcgcctctctccgccaatgccaggcgcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagtgctgcccaccaaccctgaggagagctggcaggtgtacagctctgcccaggacagcgagggcaggtgtatctgcacagtggtcgccccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtccaatcttgaagaaaggctccgtgcatgcatgcaaaaactagcttgcgggaagttgacgggcatcagtgaccccgtgactgtcaagacctccggctcgaggttcggatcctggatgacagaccctctcgcccctgaaggcgataaccgggtgtggtacatggacggctatcacaacaaccgcttcgtacgtgagtacaagtccatggttgacttcatgaacacggacaatttcacctcccaccgtctcccccacccctggtcgggcacggggcaggtggtctacaacggttctatctacttcaacaagttccagagccacatcatcatcaggtttgacctgaagacagagaccatcctcaagacccgcagcctggactatgccggttacaacaacatgtaccactacgcctggggtggccactcggacatcgacctcatggtggacgagagcgggctgtgggccgtgtacgccaccaaccagaacgctggcaacatcgtggtcagtaggctggaccccgtgtccctgcagaccctgcagacctgggaacacgagctaccccaagcgcagcgccggggaggccttcatcatctgcggcacgctgtacgtcaccaacggctactcagggggtaccaaggtccactatgcataccagaccaatgcctccacctatgaatacatcgacatcccattccagaacaaatactcccacatctccatgctggactacaaccccaaggaccgggccctgtatgcctggaacaacggccaccagatcctctacaacgtgaccctcttccacgtcatccgctccgacgagttgtagctccctcctcctggaagccaagggcccacgtcctcaccacaaagggactcctgtgaaactgctgccaaaaagataccaataacactaacaataccgatcttgaaaaatcatcagcagtgcggattctgacatcgagggatggcattacctccgtgtttctccctttcgagccggcgggccacagacgtcggaagaaactcccgtatttgcagctggaactgcagcccacggcgccccggttttcctccccgccctgtccctctctggtcaaacaacatactaaagaggcgaggcaatgactgttggcccagttctcaccggggaaaaaaccccactgttaggatggccatgaaacatttcccttagaatcgtggtcaagctcccgaggaatgtggcgtccccaggctctttgaagagccatgggctgcaccccggccgtaggcctagtgtaactcgcatccccattgcagtgcccgtttcttgactgtgttgctgtctcttagattaaccgtgctgaggctcccacatagctccctggacctgtgtcctagtacatactgaagcgatggtcagagtgtgtagagtgaagttgctgtgcccacattgtttgaactcgcgtaccccgtagatacattgtgcaacgttcttctgttattcccttgaggtggtaacttcgtatgttcagtttatgcgatgattgttgtaaatgcaatgccgtagtttggattaataagtggatggtttttgtttctaaaaagaaaaaaaaaatcagtgttcacccttatagagacatagtcaagttcatgttgataataatcaaaggaattactctcttcttgttaaattagctaaatcatgtaaccgcagataggaagggctcgcctggggaaactctggtttccgatgggacaggaaagtcatacgggcaacagtatgcggaaagtacgttttttaagtaaaaaacaaaggcaaactttgtactatccagttatctaaggaacaataaaaacattaggagatc

SEQ ID NO: 733660 - DNA, 1408 bp, Homo sapiens
ggcacccaccgcagcccagcgcgcgttcgtgctccgcagggcgcgcctctctccgccaatgccaggcgcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagtgctgcccaccaaccctgaggagagctggcaggtgtacagctctgcccaggacagcgagggcaggtgtatctgcacagtggtcgccccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaagggctaacttaaaagagttttttcaatgctgcagtgactgaagaagcagtccactcccatgtaaccatgaaagagagccagagagctttttgcaccatgcatttttactattattttccaatacttagcaccatttcactaaggaaccttgaatacaaccaggatcctcctttgcatgcgactgtagctgcatttcatgaatagtttgaacccttgtcaatgcattttttgaaaaagaaagaaaaaaaaaacttcgtgtatgtgactcaaagcatgtaaccttaagatgttgcattctaaactgacaataaagacctttccccacaaacaccaaaagacacacaccaccaacaccatcaacaaccccattttgtgacgccagccacttacggcgccctgcgcaaaaagccttgccacaaacacgccatcgttggcagcgagccaggtgtggcccccacaaacggcggtacaggagcaaaacaggggcacaagacgggtggcgcaccaagcgaaacacgccggggacgacgacaaagggcgccgtagagtctccccagaacacaacaaagacgcacccgcggcgccaacacagcacggttgctgagaacaacccaacgaggaatcacgcgggcacagagggagccacaacacgagg

SEQ ID NO: 733661 - DNA, 613 bp, Homo sapiens; identical to SEQ ID NO: 458133

SEQ ID NO: 733662 - DNA, 1075 bp, Homo sapiens; identical to SEQ ID NO: 458132

SEQ ID NO: 733663 - DNA, 1107 bp, Homo sapiens
  misc_feature (245)..(245): n is a, c, g, or t
agcgctcagagccggacggcgcttcccggtggcggcggaggagcccggagggacgcagccgggcaaggcagggcgcggggcgggcggcgcgaggcgcagggcgcggcgggcagaggccagcctggccaccttccctggcgcccggggaaggcgcggcgatggccggggcgcgcggggcggcggcggcggcgggcgggcggcggcgggccgagggggcgcggggacacagccaggcgcccctgccncgcccggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtgctgcccaccaaccctgaggagagctggcaggtgtacagctctgcccaggacagcgagggcaggtgtatctgcacagtggtcgccccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaagggctaacttaaaagagttttttcaatgctgcagtgactgaagaagcagtccactcccatgtaaccatgaaagagagccagagagctttttgcaccatgcatttttactattattttccaatacttagcaccatttcactaaggaaccttgaatacaaccaggatcctcctttgcatgcgactgtagctgcatttcatgaatagtttgaacccttgtcaatgcattttttgaaaaagaaagaaaaaaaaaacttcgtgtatgtgactcaaagcatgtaaccttaagatgttgcattctaaactgacaataaagacctttccc

SEQ ID NO: 733664 - DNA, 841 bp, Homo sapiens; identical to SEQ ID NO: 458137

SEQ ID NO: 733665 - DNA, 1440 bp, Homo sapiens
  misc_feature (245)..(245): n is a, c, g, or t
agcgctcagagccggacggcgcttcccggtggcggcggaggagcccggagggacgcagccgggcaaggcagggcgcggggcgggcggcgcgaggcgcagggcgcggcgggcagaggccagcctggccaccttccctggcgcccggggaaggcgcggcgatggccggggcgcgcggggcggcggcggcggcgggcgggcggcggcgggccgagggggcgcggggacacagccaggcgcccctgccncgcccggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtgctgcccaccaaccctgaggagagctggcaggtgtacagctctgcccaggacagcgagggcaggtgtatctgcacagtggtcgccccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaagggctaacttaaaagagttttttcaatgctgcagtgactgaagaagcagtccactcccatgtaaccatgaaagagagccagagagctttttgcaccatgcatttttactattattttccaatacttagcaccatttcactaaggaaccttgaatacaaccaggatcctcctttgcatgcgactgtagctgcatttcatgaatagtttgaacccttgtcaatgcattttttgaaaaagaaagaaaaaaaaaacttcgtgtatgtgactcaaagcatgtaaccttaagatgttgcattctaaactgacaataaagacctttccccacaaacaccaaaagacacacaccaccaacaccatcaacaaccccattttgtgacgccagccacttacggcgccctgcgcaaaaagccttgccacaaacacgccatcgttggcagcgagccaggtgtggcccccacaaacggcggtacaggagcaaaacaggggcacaagacgggtggcgcaccaagcgaaacacgccggggacgacgacaaagggcgccgtagagtctccccagaacacaacaaagacgcacccgcggcgccaacacagcacggttgctgagaacaacccaacgaggaatcacgcgggcacagagggagccacaacacgagg

SEQ ID NO: 733666 - DNA, 1701 bp, Homo sapiens
ggcacccaccgcagcccagcgcgcgttcgtgctccgcagggcgcgcctctctccgccaatgccaggcgcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagtgctgcccaccaaccctgaggagagctggcaggtgtacagctctgcccaggacagcgagggcaggtgtatctgcacagtggtcgccccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtccaatcttgaagaaaggctccgtgcatgcatgcaaaaactagcttgcgggaagttgacgggcatcagtgaccccgtgactgtcaagacctccggctcgaggttcggatcctggatgacagaccctctcgcccctgaaggcgataaccgggtgtggtacatggacggctatcacaacaaccgcttcgtacgtgagtacaagtccatggttgacttcatgaacacggacaatttcacctcccaccgtctcccccacccctggtcgggcacggggcaggtggtctacaacggttctatctacttcaacaagttccagagccacatcatcatcaggtttgacctgaagacagagaccatcctcaagacccgcagcctggactatgccggttacaacaacatgtaccactacgcctggggtggccactcggacatcgacctcatggtggacgagagcgggctgtgggccgtagtttggattaataagtggatggtttttgtttctaaaaagaaaaaaaaaatcagtgttcacccttatagagacatagtcaagttcatgttgataataatcaaaggaattactctcttcttgttaaattagctaaatcatgtaaccgcagataggaagggctcgcctggggaaactctggtttccgatgggacaggaaagtcatacgggcaacagtatgcggaaagtacgttttttaagtaaaaaacaaaggcaaactttgtactatccagttatctaaggaacaataaaaacattaggagatc

SEQ ID NO: 733667 - DNA, 2829 bp, Homo sapiens; identical to SEQ ID NO: 293419

SEQ ID NO: 733668 - DNA, 795 bp, Homo sapiens
aggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggta

SEQ ID NO: 733669 - DNA, 783 bp, Homo sapiens
tctgtctgacctgacaagccacctcaagtggacaaggcacttaccaacagagattgctgatttgctccttaagcaagagattcactgccgctaagcatggctcagaccaactcgttcttcatgctgatctcctccctgatgttcctgtctctgagccaaggccaggagtcccagacagagctgcctaatccccgaatcagctgcccagaaggcaccaatgcctatcgctcctactgctactactttaatgaagaccctgagacctgggttgatgcagatctctattgccagaacatgaattcaggcaacctggtgtctgtgctcacccaggcggagggtgccttcgtggcctcactgattaaggagagtagcactgatgacagcaatgtctggattggcctccatgacccaaaaaagaaccgccgctggcactggagtagtgggtccctggtctcctacaagtcctgggacactggatccccgagcagtgctaatgctggctactgtgcaagcctgacttcatgctcaggattcaagaaatggaaggatgaatcttgtgagaagaagttctcctttgtttgcaagttcaaaaactagaggaagctgaaaaatggatgtctagaactggtcctgcaattactatgaagtcaaaaattaaactagactatgtctccaactcagttcagaccatctcctccctaatgagtttgcatcgctgatcttcagtaccttcacctgtctcagtctctagagccctgaaaaataaaaacaaacttattttta

SEQ ID NO: 733670 - DNA, 869 bp, Homo sapiens
tctgtctgacctgacaagccacctcaagtggacaaggcacttaccaacagagattgctgatttgctccttaagcaagagattcactgccgctaagcatggctcagaccaactcgttcttcatgctgatctcctccctgatgttcctgtctctgagccaaggccaggagtcccagacagagctgcctaatccccgaatcagctgcccagaaggcaccaatgcctatcgctcctactgctactactttaatgaagaccctgagacctgggttgatgcagatctctattgccagaacatgaattcaggcaacctggtgtctgtgctcacccaggcggagggtgccttcgtggcctcactgattaaggagagtagcactgatgacagcaatgtctggattggcctccatgacccaaaaaagaaccgccgctggcactggagtagtgggtccctggtctcctacaagtcctgggacactggatccccgagcagtgctaatgctggctactgtgcaagcctgacttcatgctcaggtgagaggcagacaatctatccacctgttgccatttccttcccacttatctctggggatgaacatggggactgggatagaggaaaggattcaagaaatggaaggatgaatcttgtgagaagaagttctcctttgtttgcaagttcaaaaactagaggaagctgaaaaatggatgtctagaactggtcctgcaattactatgaagtcaaaaattaaactagactatgtctccaactcagttcagaccatctcctccctaatgagtttgcatcgctgatcttcagtaccttcacctgtctcagtctctagagccctgaaaaataaaaacaaacttattttta

SEQ ID NO: 733671 - DNA, 212 bp, Homo sapiens; identical to SEQ ID NO: 305432

SEQ ID NO: 733672 - DNA, 870 bp, Homo sapiens
tgaccccaggagagctcggatcctccgcagggtacctagctatgtgccctgcaggcacagagacttgggagccacaggcagtgatgatcaccagggttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggacgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctg

SEQ ID NO: 733673 - DNA, 590 bp, Homo sapiens
ccgcatccaggtgagactgggagagcacaacatcgaagtcctggaggggaatgagcagttcatcaatgcagccaagatcatccgccacccccaatacgacaggaagactctgaacaatgacatcatgttaatcaaggcccgcgtgtccaccatctctctgcccaccgcccctccagccactggcacgaagtgcctcatctctggctggggcaacactgcgagctctggcgccgactacccagacgagctgcagtgcctggacgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctg

SEQ ID NO: 733674 - DNA, 1075 bp, Homo sapiens
  misc_feature (1)..(1): n is a, c, g, or t
  misc_feature (4)..(4): n is a, c, g, or t
  misc_feature (39)..(39): n is a, c, g, or t
naanctcggatacacacaagcctcgcagaacatcaggancgtgggagcagaagtggcatattttgttgaatttcttcagtcggcgttcggttactcaccttccaacgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgca

SEQ ID NO: 733675 - DNA, 566 bp, Homo sapiens
  misc_feature (22)..(22): n is a, c, g, or t
ctagataaaatttctggcccanatcatttgttttcccaggatatctatcagcatagtgacccatctgtgggcagcctccacttggacaagggaaacacttgtttgcagtgaagacgttgtaagaggcacagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgca

SEQ ID NO: 733676 - DNA, 198 bp, Homo sapiens
  misc_feature (16)..(16): n is a, c, g, or t
  misc_feature (19)..(19): n is a, c, g, or t
  misc_feature (42)..(42): n is a, c, g, or t
gtagatcccccggggngcnggaattcggcacgagtgggagcntccaacattcgtctccactataatgttggaaaacagttcaacttctgtagtccagaaaccgtcagggaggaagttctgctcaccctcacaccgtgttaggagactactgttatttgaccaatgaattgacttctaataaaatctagtggtgatgca

SEQ ID NO: 733677 - DNA, 144 bp, Homo sapiens
  misc_feature (36)..(36): n is a, c, g, or t
  misc_feature (58)..(58): n is a, c, g, or t
tttttttaatgcatcaccactaaattttattaaaantcaattcattggtcaaataacngtagtctgctcaccctcacaccgtgttaggagactactgttatttgaccaatgaattgacttctaataaaatctagtggtgatgca

SEQ ID NO: 733678 - DNA, 169 bp, Homo sapiens
  misc_feature (36)..(36): n is a, c, g, or t
  misc_feature (58)..(58): n is a, c, g, or t
tttttttaatgcatcaccactaaattttattaaaantcaattcattggtcaaataacngtagtccagaaaccgtcaggggaggaagttctgctcaccctcacaccgtgttaggagactactgttatttgaccaatgaattgacttctaataaaatctagtggtgatgca

SEQ ID NO: 733679 - DNA, 1756 bp, Homo sapiens
  misc_feature (1)..(1): n is a, c, g, or t
  misc_feature (4)..(4): n is a, c, g, or t
  misc_feature (39)..(39): n is a, c, g, or t
naanctcggatacacacaagcctcgcagaacatcaggancgtgggagcagaagtggcatattttgttgaatttcttcagtcggcgttcggttactcaccttccaacgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaagtagggggggggcccgcgcgcacaacaaaagtgactgacaaacaacacaggtgggggggggcgcacccgcccgagatgacatccgcagagagagcaccgaaacagcaaaggccgcggcaccgaacagacggcgggtgacacacaacaaaaaagaaggggcgcagagacaggcgataccacaaccagacggcgacggagaaaggacggcatgaccagacgggagcgagcggcataaaaacaaaaaccgccggccggggggggaagacaaccagccaggcggagacggacaaaagacaccaagcggcgccacgccagaggagcgggcgaccacgaaaacaagcggagccggaaggggtgcagcgcgacaatacagggcagaccagccagccggggcggagcgagccacgaggacgacgacaagcggcaggcgacaacgcagggccgaccgagccgaaacaacaggcgactgccggcaaggcacgacagagtaaccaaagaggtgagagccaacgagaagcaccaaaccggcacaggtcacgtacacaa

SEQ ID NO: 733680 - DNA, 1446 bp, Homo sapiens
  misc_feature (1)..(1): n is a, c, g, or t
  misc_feature (4)..(4): n is a, c, g, or t
  misc_feature (39)..(39): n is a, c, g, or t
naanctcggatacacacaagcctcgcagaacatcaggancgtgggagcagaagtggcatattttgttgaatttcttcagtcggcgttcggttactcaccttccaacgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcaacatgagacaatgtccctgataagaacggtaaggggcagatctcgacataaattcatcctccatctcaaaatgaacttggactcctatgtcccgatatgtataatgctgcccactttaaggggcgcctcaaagtttaaacctaaggtcatggactgtgtctctggcaccatactccctaattcgctgtccaggtttttctaacacataatcactgcctgctggaacactggtgtgccaaacaagggcaagatcttccacgtgtggcaacaaaagccgatgggaattagaaattccgccccggggtcctcgcaccttggcacgtccaggttccgtaacaaaccagcacaacctctcccagactcactttatg

SEQ ID NO: 733681 - DNA, 1247 bp, Homo sapiens
  misc_feature (22)..(22): n is a, c, g, or t
ctagataaaatttctggcccanatcatttgttttcccaggatatctatcagcatagtgacccatctgtgggcagcctccacttggacaagggaaacacttgtttgcagtgaagacgttgtaagaggcacagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaagtagggggggggcccgcgcgcacaacaaaagtgactgacaaacaacacaggtgggggggggcgcacccgcccgagatgacatccgcagagagagcaccgaaacagcaaaggccgcggcaccgaacagacggcgggtgacacacaacaaaaaagaaggggcgcagagacaggcgataccacaaccagacggcgacggagaaaggacggcatgaccagacgggagcgagcggcataaaaacaaaaaccgccggccggggggggaagacaaccagccaggcggagacggacaaaagacaccaagcggcgccacgccagaggagcgggcgaccacgaaaacaagcggagccggaaggggtgcagcgcgacaatacagggcagaccagccagccggggcggagcgagccacgaggacgacgacaagcggcaggcgacaacgcagggccgaccgagccgaaacaacaggcgactgccggcaaggcacgacagagtaaccaaagaggtgagagccaacgagaagcaccaaaccggcacaggtcacgtacacaa

SEQ ID NO: 733682 - DNA, 937 bp, Homo sapiens
  misc_feature (22)..(22): n is a, c, g, or t
ctagataaaatttctggcccanatcatttgttttcccaggatatctatcagcatagtgacccatctgtgggcagcctccacttggacaagggaaacacttgtttgcagtgaagacgttgtaagaggcacagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcaacatgagacaatgtccctgataagaacggtaaggggcagatctcgacataaattcatcctccatctcaaaatgaacttggactcctatgtcccgatatgtataatgctgcccactttaaggggcgcctcaaagtttaaacctaaggtcatggactgtgtctctggcaccatactccctaattcgctgtccaggtttttctaacacataatcactgcctgctggaacactggtgtgccaaacaagggcaagatcttccacgtgtggcaacaaaagccgatgggaattagaaattccgccccggggtcctcgcaccttggcacgtccaggttccgtaacaaaccagcacaacctctcccagactcactttatg

SEQ ID NO: 733683 - DNA, 892 bp, Homo sapiens; identical to SEQ ID NO: 46288

SEQ ID NO: 733684 - DNA, 1299 bp, Homo sapiens
gggaccggcagacaggcgtcctacacccctgccagcggcaccatggctttcctctggctcctctcctgctgggccctcctgggtaccaccttcggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggcgactctggcggccccctggtctgccaaaaggatggagcctggaccctggtgggcattgtgtcctggggcagcgacacctgctccacctccagccctggcgtgtacgcccgtgtcaccaagctcataccttgggtgcagaagatcctggctgccaactgagcccgcggctccctccgaccctgctccccacagagcctcagtaaacccatggaacacaaaaaaaaaaaaaaaaaaaaaaaaaaaaaaacacgtggtgtgcgcgcgcgcgcgccccgcggcccccctgagaaaacccctttcctataaaccacactcgggtggggcgcgcgccgggccacccagttaggtaaagggaacaacggtggccaagcgagggggcatccccaagagggaacaccggggcgacgagtgcacaagagggcgcgcgggaattctcctaccacacattaaacaaaccgcgcgcgggggggagaacccccgagaccggtcctgtgagaaccaatactcccgaaagctgggagcagcctcagaagggccaactacagggggagatcatcctcaccagggagcgcgccccagggaggctcgacatatccaaatttaacagcccccgagtcaggggga

SEQ ID NO: 733685 - DNA, 421 bp, Homo sapiens
tctcttgctctgggccctgcaggagggcgtgggcagcgtgggggctgtggggggatgagctcactctggccccacagacctgtggctccaaggaatcttcccacggccactcctagggctgccagacatacgctggagccaggagcgttatcaacgcaaggactggtgatgagtagagacggggtttcaccgtgttaaccaggatggtctcgatctcctgacctcgtcatccgcccgccttggcctcccaaagtgctgcgattacaggcctgagccaccgcgcccagccctatggcaatgactcttaaaagttcgaggctcaggcaggccgggagccccaggtcaaacatgcccatccccagccccaaatgcccagaagcaaaaagcccgccgtgccatgtttcatcaaggcaccacatcc

SEQ ID NO: 733686 - DNA, 584 bp, Homo sapiens
gtgtcaccaagctcataccttgggtgcagaagatcctggctgccaactgagcccgcggctccctccgaccctgctccccacagagcctcagtaaacccatggaacacacgtcggcgctgtccgtcttctgttttggggcctccaaggcctcactccactccggaacctgggcccccactgggctggactgggctgggctaggcatgggcggcctctgggaggacccttccttagtcccctctcccaccactcaggctcctgcttcccagagagtggccaggaacacacgggcagatgaaaaggggtgcagagacagacgggggatctggctggtggggaccgggtggaccttggcccccatcctcagcacctgcccccaggcgacaggttcttgcacaacaccacccttgctctcttgctctgggccctgcaggagggcgtgggcagcgtgggggctgtggggggatgagctcactctggccccacagacctgtggctccaaggaatcttcccacggccactcctagggctgccagacatacgctggagccaggagcgttatcaacgcaaggactggtgatgag

SEQ ID NO: 733687 - DNA, 782 bp, Homo sapiens; identical to SEQ ID NO: 46361

SEQ ID NO: 733688 - DNA, 693 bp, Homo sapiens; identical to SEQ ID NO: 46360
  misc_feature (33)..(34): n is a, c, g, or t

SEQ ID NO: 733689 - DNA, 716 bp, Homo sapiens; identical to SEQ ID NO: 46362
  misc_feature (33)..(34): n is a, c, g, or t

SEQ ID NO: 733690 - DNA, 439 bp, Homo sapiens
  misc_feature (8)..(8): n is a, c, g, or t
  misc_feature (189)..(189): n is a, c, g, or t
  misc_feature (201)..(201): n is a, c, g, or t
  misc_feature (206)..(206): n is a, c, g, or t
  misc_feature (209)..(209): n is a, c, g, or t
  misc_feature (212)..(213): n is a, c, g, or t
  misc_feature (220)..(222): n is a, c, g, or t
  misc_feature (235)..(235): n is a, c, g, or t
  misc_feature (248)..(248): n is a, c, g, or t
  misc_feature (259)..(259): n is a, c, g, or t
  misc_feature (295)..(295): n is a, c, g, or t
  misc_feature (306)..(306): n is a, c, g, or t
  misc_feature (361)..(361): n is a, c, g, or t
  misc_feature (371)..(371): n is a, c, g, or t
  misc_feature (411)..(411): n is a, c, g, or t
ccggctgntcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagctcatcgcccccgantggttgtgactnccggncantgnntctgagnnnctgacctaccagnggtgttgggtgantacaaccttgntgtgaaggagggccccgagcaggtgatccccatcanctctgaggagntgtgtgtgcatccactctggaaccgctcgtgtgtggtctgtggtaatgacatcgncctcatcaanctctcacgcagcgcccagctgggagatgcgtccagttcgnctcactccctcccggtggtgacatcctc

SEQ ID NO: 733691 - DNA, 510 bp, Homo sapiens
  misc_feature (260)..(260): n is a, c, g, or t
  misc_feature (272)..(272): n is a, c, g, or t
  misc_feature (277)..(277): n is a, c, g, or t
  misc_feature (280)..(280): n is a, c, g, or t
  misc_feature (283)..(284): n is a, c, g, or t
  misc_feature (291)..(293): n is a, c, g, or t
  misc_feature (306)..(306): n is a, c, g, or t
  misc_feature (319)..(319): n is a, c, g, or t
  misc_feature (330)..(330): n is a, c, g, or t
  misc_feature (366)..(366): n is a, c, g, or t
  misc_feature (377)..(377): n is a, c, g, or t
  misc_feature (432)..(432): n is a, c, g, or t
  misc_feature (442)..(442): n is a, c, g, or t
  misc_feature (482)..(482): n is a, c, g, or t
cttgtggccgttgagatgaggtcttgctatgttgcccaggctggtctcaaactcgtgcgctcaagcgatcctcccgcctcggcctctcaaagcactaggattacagcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagctcatcgcccccgantggttgtgactnccggncantgnntctgagnnnctgacctaccagnggtgttgggtgantacaaccttgntgtgaaggagggccccgagcaggtgatccccatcanctctgaggagntgtgtgtgcatccactctggaaccgctcgtgtgtggtctgtggtaatgacatcgncctcatcaanctctcacgcagcgcccagctgggagatgcgtccagttcgnctcactccctcccggtggtgacatcctc

SEQ ID NO: 733692 - DNA, 960 bp, Homo sapiens
tattaaaataaagagaaagcctagccgggcgcgggggctcatgcctgtaatcccagcactttgggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733693 - DNA, 589 bp, Homo sapiens
gaaaatgcgtattcatgtgaataagctttgattcactgcatatgtacaatcagagaacacccagagaaaacagagagtctttctactgaacttgaaagatacatcacagctgagtcagctctgaatacactgttagaaaaaaaaaaagtaaatatctggattcatgggagtattctgggtatttactatcccaacactaatacaacttctctccccccacaaaatgttgctgaaaatacagtgatggtttaataagaaggctacttttgactaacattgttctattaccctccttttcctagaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatggtatttctatttcacttttttgaaaagacatttgggtggaaaaaactcaatttgatgcgaaattaacatgtgcattttc

SEQ ID NO: 733694 - DNA, 1703 bp, Homo sapiens
  misc_feature (1687)..(1687): n is a, c, g, or t
tttctttcgacggggtgtcaccgtgtaagccaggatggtcttgatctcctgacctcatgatctgcccacctcggcctcccaaaatgctgggattacaggtgtaagccaccacgcccagccctgaattgtttctttagaactatttctcagctactcaatttatgcataaaagattaaagtattcattaatgaatgttatgacctcagatttgtacacaataagttatacatgtgagatagtggaatatatacagaattaagatggtgaaacttgaaaatttctttctaaagttttcggttagatttctgtattcttcagtaattgcaaattgcagcacaaacatctccacacgtttctgtcctatccatttgttacctctcccaccaccacccctgaatccttgaaatgatagtctcttgagtagtatttaatgtttgcagagggagacaatacaggcatttcccccagacacagagatttttgaaaagttcaacaaacaaggaaaacttgctttggcagagaatttgataaagctttatagctgtactgtgttgaatatgcaaaatcttgagttaatgtggtgatggttactgtggatgttctcttgtttgtgtacatataaatgtttgctccagtggttacctggaaattagtatgcatatattattgattaataatggaatgagagctgttaaaaacattaaagcaaaactaccaacacgacaaaatttaccaaatcatgccacatattgtccttgaaacttaccccatttttacctaaccatatctggtatttgggtttaacttctttttacatttaaaggatacaaagatgtagcttcagaagaaattctatccagtttacaaaaatttagaattaccaaaatatagcatgtaagcttacctgcaatttgaagcacatctttttaaaggtttagtatgatattttggattcagactgaggcttctatgggattagattttcttcagttacttcagtaatcaccataatttaaaaattctggtattataacatttctaattttcttctcttttttataaagttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaaaaaaaaaaaaaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733695 - DNA, 772 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatggtatttctatttcacttttttgaaaagacatttgggtggaaaaaactcaatttgatgcgaaattaacatgtgcattttc

SEQ ID NO: 733696 - DNA, 3324 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatcacaaaagaaaaagcatttctttaagcattcaaacccaaatgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgcagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 733697 - DNA, 1999 bp, Homo sapiens
  misc_feature (1983)..(1983): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgaaaaaaaaaaaaaaaaacaaaaaaaaaaaaaaaacacaaacaacacaacaaagaaaanaaacaaaaaaaaagaa

SEQ ID NO: 733698 - DNA, 2084 bp, Homo sapiens
  misc_feature (1960)..(1960): n is a, c, g, or t
  misc_feature (1965)..(1965): n is a, c, g, or t
  misc_feature (1970)..(1970): n is a, c, g, or t
  misc_feature (2048)..(2048): n is a, c, g, or t
  misc_feature (2061)..(2061): n is a, c, g, or t
  misc_feature (2080)..(2080): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgaaaaaaaaaaaaaaaaacaaaaaaaaaaaaaattncctgnggccncaggctttttccctttggtgggggttatttttggcttggccctggccgtccgttttccaccgtcgtgcctgggggaanccccggggggttnccccacctttttccccttnacgg

SEQ ID NO: 733699 - DNA, 2346 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgaaaaaaaaaaaaaaaaacaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733700 - DNA, 2033 bp, Homo sapiens
  misc_feature (2017)..(2017): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733701 - DNA, 1428 bp, Homo sapiens
  misc_feature (1412)..(1412): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaacaaaaaaaaaaaaaaaaaaaaaaaaaaaaaaaaaaaaaacaaaaaaaaaaaaaaaacacaaacaacacaacaaagaaaanaaacaaaaaaaaagaa

SEQ ID NO: 733702 - DNA, 1513 bp, Homo sapiens
  misc_feature (1389)..(1389): n is a, c, g, or t
  misc_feature (1394)..(1394): n is a, c, g, or t
  misc_feature (1399)..(1399): n is a, c, g, or t
  misc_feature (1477)..(1477): n is a, c, g, or t
  misc_feature (1490)..(1490): n is a, c, g, or t
  misc_feature (1509)..(1509): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaacaaaaaaaaaaaaaaaaaaaaaaaaaaaaaaaaaaaaaacaaaaaaaaaaaaaattncctgnggccncaggctttttccctttggtgggggttatttttggcttggccctggccgtccgttttccaccgtcgtgcctgggggaanccccggggggttnccccacctttttccccttnacgg

SEQ ID NO: 733703 - DNA, 1775 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaacaaaaaaaaaaaaaaaaaaaaaaaaaaaaaaaaaaaaaacaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733704 - DNA, 1744 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaacaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733705 - DNA, 1481 bp, Homo sapiens
  misc_feature (1465)..(1465): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaacaaaaaaaaaaaaaaaaaaaaaaaaaaaaaaaaaaaaaaaaaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733706 - DNA, 1763 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaacaaaaaaaaaaaaaaaaaaaaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733707 - DNA, 1462 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaatagggttgcaataaccctttggttaaagtgggtatttttgccagaaaaagggggtaaaattaaattccctttggtggttgggagagaaagggggtaacaactcggggagagaataaaaggtgggggatttacccactggg

SEQ ID NO: 733708 - DNA, 1397 bp, Homo sapiens
  misc_feature (1381)..(1381): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaaaaaaaaaacaaaaaaaaaaaaaaaacacaaacaacacaacaaagaaaanaaacaaaaaaaaagaa

SEQ ID NO: 733709 - DNA, 1482 bp, Homo sapiens
  misc_feature (1358)..(1358): n is a, c, g, or t
  misc_feature (1363)..(1363): n is a, c, g, or t
  misc_feature (1368)..(1368): n is a, c, g, or t
  misc_feature (1446)..(1446): n is a, c, g, or t
  misc_feature (1459)..(1459): n is a, c, g, or t
  misc_feature (1478)..(1478): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaaaaaaaaaacaaaaaaaaaaaaaattncctgnggccncaggctttttccctttggtgggggttatttttggcttggccctggccgtccgttttccaccgtcgtgcctgggggaanccccggggggttnccccacctttttccccttnacgg

SEQ ID NO: 733710 - DNA, 1744 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaaaaaaaaaacaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733711 - DNA, 1450 bp, Homo sapiens
  misc_feature (1434)..(1434): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaaaaaaaaaaaaaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733712 - DNA, 1732 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733713 - DNA, 1431 bp, Homo sapiens
  misc_feature (1415)..(1415): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733714 - DNA, 1319 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacattaactttcaggatcacgatgtcactcaaggaacagctatgccatagtacgtc

SEQ ID NO: 733715 - DNA, 1309 bp, Homo sapiens
  misc_feature (1293)..(1293): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaacaaaaaaaaaaaaaaaaaaaaaaaaaaaaaaaaaaaaaacaaaaaaaaaaaaaaaacacaaacaacacaacaaagaaaanaaacaaaaaaaaagaa

SEQ ID NO: 733716 - DNA, 1394 bp, Homo sapiens
  misc_feature (1270)..(1270): n is a, c, g, or t
  misc_feature (1275)..(1275): n is a, c, g, or t
  misc_feature (1280)..(1280): n is a, c, g, or t
  misc_feature (1358)..(1358): n is a, c, g, or t
  misc_feature (1371)..(1371): n is a, c, g, or t
  misc_feature (1390)..(1390): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaacaaaaaaaaaaaaaaaaaaaaaaaaaaaaaaaaaaaaaacaaaaaaaaaaaaaattncctgnggccncaggctttttccctttggtgggggttatttttggcttggccctggccgtccgttttccaccgtcgtgcctgggggaanccccggggggttnccccacctttttccccttnacgg

SEQ ID NO: 733717 - DNA, 1656 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaacaaaaaaaaaaaaaaaaaaaaaaaaaaaaaaaaaaaaaacaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733718 - DNA, 1625 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaacaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733719 - DNA, 1362 bp, Homo sapiens
  misc_feature (1346)..(1346): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaacaaaaaaaaaaaaaaaaaaaaaaaaaaaaaaaaaaaaaaaaaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733720 - DNA, 1644 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaacaaaaaaaaaaaaaaaaaaaaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733721 - DNA, 1332 bp, Homo sapiens
  misc_feature (1316)..(1316): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgacaaaaaaaaaaaaaaaaaaaaaaaaaaaaacaaaaaaaaaaaaaaaaaaaaaaaaaaaaaaaaaaaaaacaaaaaaaaaaaaaaaacacaaacaacacaacaaagaaaanaaacaaaaaaaaagaa

SEQ ID NO: 733722 - DNA, 1417 bp, Homo sapiens
  misc_feature (1293)..(1293): n is a, c, g, or t
  misc_feature (1298)..(1298): n is a, c, g, or t
  misc_feature (1303)..(1303): n is a, c, g, or t
  misc_feature (1381)..(1381): n is a, c, g, or t
  misc_feature (1394)..(1394): n is a, c, g, or t
  misc_feature (1413)..(1413): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgacaaaaaaaaaaaaaaaaaaaaaaaaaaaaacaaaaaaaaaaaaaaaaaaaaaaaaaaaaaaaaaaaaaacaaaaaaaaaaaaaattncctgnggccncaggctttttccctttggtgggggttatttttggcttggccctggccgtccgttttccaccgtcgtgcctgggggaanccccggggggttnccccacctttttccccttnacgg

SEQ ID NO: 733723 - DNA, 1679 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgacaaaaaaaaaaaaaaaaaaaaaaaaaaaaacaaaaaaaaaaaaaaaaaaaaaaaaaaaaaaaaaaaaaacaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733724 - DNA, 1648 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgacaaaaaaaaaaaaaaaaaaaaaaaaaaaaacaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733725 - DNA, 1385 bp, Homo sapiens
  misc_feature (1369)..(1369): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgacaaaaaaaaaaaaaaaaaaaaaaaaaaaaacaaaaaaaaaaaaaaaaaaaaaaaaaaaaaaaaaaaaaaaaaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733726 - DNA, 1667 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgacaaaaaaaaaaaaaaaaaaaaaaaaaaaaacaaaaaaaaaaaaaaaaaaaaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733727 - DNA, 1331 bp, Homo sapiens
  misc_feature (1315)..(1315): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaaaaaaaaaaaaaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733728 - DNA, 1613 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733729 - DNA, 1312 bp, Homo sapiens
  misc_feature (1296)..(1296): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733730 - DNA, 966 bp, Homo sapiens
  misc_feature (950)..(950): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaaaaaaaaacaaaaaaaaaaaaaaaaaaaaaaaaaaaaaaaaaaaaaacaaaaaaaaaaaaaaaacacaaacaacacaacaaagaaaanaaacaaaaaaaaagaa

SEQ ID NO: 733731 - DNA, 1051 bp, Homo sapiens
  misc_feature (927)..(927): n is a, c, g, or t
  misc_feature (932)..(932): n is a, c, g, or t
  misc_feature (937)..(937): n is a, c, g, or t
  misc_feature (1015)..(1015): n is a, c, g, or t
  misc_feature (1028)..(1028): n is a, c, g, or t
  misc_feature (1047)..(1047): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaaaaaaaaacaaaaaaaaaaaaaaaaaaaaaaaaaaaaaaaaaaaaaacaaaaaaaaaaaaaattncctgnggccncaggctttttccctttggtgggggttatttttggcttggccctggccgtccgttttccaccgtcgtgcctgggggaanccccggggggttnccccacctttttccccttnacgg

SEQ ID NO: 733732 - DNA, 1313 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaaaaaaaaacaaaaaaaaaaaaaaaaaaaaaaaaaaaaaaaaaaaaaacaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733733 - DNA, 1282 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaaaaaaaaacaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733734 - DNA, 1019 bp, Homo sapiens
  misc_feature (1003)..(1003): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaaaaaaaaacaaaaaaaaaaaaaaaaaaaaaaaaaaaaaaaaaaaaaaaaaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733735 - DNA, 1301 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaaaaaaaaacaaaaaaaaaaaaaaaaaaaaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733736 - DNA, 868 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttagcagtgaaatggaaactgggatcctctagacgccacc

SEQ ID NO: 733737 - DNA, 3446 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatcacaaaagaaaaagcatttctttaagcattcaaacccaaatgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgcagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 733738 - DNA, 2121 bp, Homo sapiens
  misc_feature (2105)..(2105): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgaaaaaaaaaaaaaaaaacaaaaaaaaaaaaaaaacacaaacaacacaacaaagaaaanaaacaaaaaaaaagaa

SEQ ID NO: 733739 - DNA, 2206 bp, Homo sapiens
  misc_feature (2082)..(2082): n is a, c, g, or t
  misc_feature (2087)..(2087): n is a, c, g, or t
  misc_feature (2092)..(2092): n is a, c, g, or t
  misc_feature (2170)..(2170): n is a, c, g, or t
  misc_feature (2183)..(2183): n is a, c, g, or t
  misc_feature (2202)..(2202): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgaaaaaaaaaaaaaaaaacaaaaaaaaaaaaaattncctgnggccncaggctttttccctttggtgggggttatttttggcttggccctggccgtccgttttccaccgtcgtgcctgggggaanccccggggggttnccccacctttttccccttnacgg

SEQ ID NO: 733740 - DNA, 2468 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgaaaaaaaaaaaaaaaaacaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733741 - DNA, 2155 bp, Homo sapiens
  misc_feature (2139)..(2139): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733742 - DNA, 1550 bp, Homo sapiens
  misc_feature (1534)..(1534): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaacaaaaaaaaaaaaaaaaaaaaaaaaaaaaaaaaaaaaaacaaaaaaaaaaaaaaaacacaaacaacacaacaaagaaaanaaacaaaaaaaaagaa

SEQ ID NO: 733743 - DNA, 1635 bp, Homo sapiens
  misc_feature (1511)..(1511): n is a, c, g, or t
  misc_feature (1516)..(1516): n is a, c, g, or t
  misc_feature (1521)..(1521): n is a, c, g, or t
  misc_feature (1599)..(1599): n is a, c, g, or t
  misc_feature (1612)..(1612): n is a, c, g, or t
  misc_feature (1631)..(1631): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaacaaaaaaaaaaaaaaaaaaaaaaaaaaaaaaaaaaaaaacaaaaaaaaaaaaaattncctgnggccncaggctttttccctttggtgggggttatttttggcttggccctggccgtccgttttccaccgtcgtgcctgggggaanccccggggggttnccccacctttttccccttnacgg

SEQ ID NO: 733744 - DNA, 1897 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaacaaaaaaaaaaaaaaaaaaaaaaaaaaaaaaaaaaaaaacaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733745 - DNA, 1866 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaacaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733746 - DNA, 1603 bp, Homo sapiens
  misc_feature (1587)..(1587): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaacaaaaaaaaaaaaaaaaaaaaaaaaaaaaaaaaaaaaaaaaaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733747 - DNA, 1885 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaacaaaaaaaaaaaaaaaaaaaaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733748 - DNA, 1584 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaatagggttgcaataaccctttggttaaagtgggtatttttgccagaaaaagggggtaaaattaaattccctttggtggttgggagagaaagggggtaacaactcggggagagaataaaaggtgggggatttacccactggg

SEQ ID NO: 733749 - DNA, 1519 bp, Homo sapiens
  misc_feature (1503)..(1503): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaaaaaaaaaacaaaaaaaaaaaaaaaacacaaacaacacaacaaagaaaanaaacaaaaaaaaagaa

SEQ ID NO: 733750 - DNA, 1604 bp, Homo sapiens
  misc_feature (1480)..(1480): n is a, c, g, or t
  misc_feature (1485)..(1485): n is a, c, g, or t
  misc_feature (1490)..(1490): n is a, c, g, or t
  misc_feature (1568)..(1568): n is a, c, g, or t
  misc_feature (1581)..(1581): n is a, c, g, or t
  misc_feature (1600)..(1600): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaaaaaaaaaacaaaaaaaaaaaaaattncctgnggccncaggctttttccctttggtgggggttatttttggcttggccctggccgtccgttttccaccgtcgtgcctgggggaanccccggggggttnccccacctttttccccttnacgg

SEQ ID NO: 733751 - DNA, 1866 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaaaaaaaaaacaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733752 - DNA, 1572 bp, Homo sapiens
  misc_feature (1556)..(1556): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaaaaaaaaaaaaaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733753 - DNA, 1854 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733754 - DNA, 1553 bp, Homo sapiens
  misc_feature (1537)..(1537): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733755 - DNA, 1441 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacattaactttcaggatcacgatgtcactcaaggaacagctatgccatagtacgtc

SEQ ID NO: 733756 - DNA, 1431 bp, Homo sapiens
  misc_feature (1415)..(1415): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaacaaaaaaaaaaaaaaaaaaaaaaaaaaaaaaaaaaaaaacaaaaaaaaaaaaaaaacacaaacaacacaacaaagaaaanaaacaaaaaaaaagaa

SEQ ID NO: 733757 - DNA, 1516 bp, Homo sapiens
  misc_feature (1392)..(1392): n is a, c, g, or t
  misc_feature (1397)..(1397): n is a, c, g, or t
  misc_feature (1402)..(1402): n is a, c, g, or t
  misc_feature (1480)..(1480): n is a, c, g, or t
  misc_feature (1493)..(1493): n is a, c, g, or t
  misc_feature (1512)..(1512): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaacaaaaaaaaaaaaaaaaaaaaaaaaaaaaaaaaaaaaaacaaaaaaaaaaaaaattncctgnggccncaggctttttccctttggtgggggttatttttggcttggccctggccgtccgttttccaccgtcgtgcctgggggaanccccggggggttnccccacctttttccccttnacgg

SEQ ID NO: 733758 - DNA, 1778 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaacaaaaaaaaaaaaaaaaaaaaaaaaaaaaaaaaaaaaaacaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733759 - DNA, 1747 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaacaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733760 - DNA, 1484 bp, Homo sapiens
  misc_feature (1468)..(1468): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaacaaaaaaaaaaaaaaaaaaaaaaaaaaaaaaaaaaaaaaaaaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733761 - DNA, 1766 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaacaaaaaaaaaaaaaaaaaaaaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733762 - DNA, 1454 bp, Homo sapiens
  misc_feature (1438)..(1438): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgacaaaaaaaaaaaaaaaaaaaaaaaaaaaaacaaaaaaaaaaaaaaaaaaaaaaaaaaaaaaaaaaaaaacaaaaaaaaaaaaaaaacacaaacaacacaacaaagaaaanaaacaaaaaaaaagaa

SEQ ID NO: 733763 - DNA, 1539 bp, Homo sapiens
  misc_feature (1415)..(1415): n is a, c, g, or t
  misc_feature (1420)..(1420): n is a, c, g, or t
  misc_feature (1425)..(1425): n is a, c, g, or t
  misc_feature (1503)..(1503): n is a, c, g, or t
  misc_feature (1516)..(1516): n is a, c, g, or t
  misc_feature (1535)..(1535): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgacaaaaaaaaaaaaaaaaaaaaaaaaaaaaacaaaaaaaaaaaaaaaaaaaaaaaaaaaaaaaaaaaaaacaaaaaaaaaaaaaattncctgnggccncaggctttttccctttggtgggggttatttttggcttggccctggccgtccgttttccaccgtcgtgcctgggggaanccccggggggttnccccacctttttccccttnacgg

SEQ ID NO: 733764 - DNA, 1801 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgacaaaaaaaaaaaaaaaaaaaaaaaaaaaaacaaaaaaaaaaaaaaaaaaaaaaaaaaaaaaaaaaaaaacaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733765 - DNA, 1770 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgacaaaaaaaaaaaaaaaaaaaaaaaaaaaaacaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733766 - DNA, 1507 bp, Homo sapiens
  misc_feature (1491)..(1491): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgacaaaaaaaaaaaaaaaaaaaaaaaaaaaaacaaaaaaaaaaaaaaaaaaaaaaaaaaaaaaaaaaaaaaaaaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733767 - DNA, 1789 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgacaaaaaaaaaaaaaaaaaaaaaaaaaaaaacaaaaaaaaaaaaaaaaaaaaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733768 - DNA, 1453 bp, Homo sapiens
  misc_feature (1437)..(1437): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaaaaaaaaaaaaaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733769 - DNA, 1735 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733770 - DNA, 1434 bp, Homo sapiens
  misc_feature (1418)..(1418): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733771 - DNA, 1088 bp, Homo sapiens
  misc_feature (1072)..(1072): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaaaaaaaaacaaaaaaaaaaaaaaaaaaaaaaaaaaaaaaaaaaaaaacaaaaaaaaaaaaaaaacacaaacaacacaacaaagaaaanaaacaaaaaaaaagaa

SEQ ID NO: 733772 - DNA, 1173 bp, Homo sapiens
  misc_feature (1049)..(1049): n is a, c, g, or t
  misc_feature (1054)..(1054): n is a, c, g, or t
  misc_feature (1059)..(1059): n is a, c, g, or t
  misc_feature (1137)..(1137): n is a, c, g, or t
  misc_feature (1150)..(1150): n is a, c, g, or t
  misc_feature (1169)..(1169): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaaaaaaaaacaaaaaaaaaaaaaaaaaaaaaaaaaaaaaaaaaaaaaacaaaaaaaaaaaaaattncctgnggccncaggctttttccctttggtgggggttatttttggcttggccctggccgtccgttttccaccgtcgtgcctgggggaanccccggggggttnccccacctttttccccttnacgg

SEQ ID NO: 733773 - DNA, 1435 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaaaaaaaaacaaaaaaaaaaaaaaaaaaaaaaaaaaaaaaaaaaaaaacaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733774 - DNA, 1404 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaaaaaaaaacaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733775 - DNA, 1141 bp, Homo sapiens
  misc_feature (1125)..(1125): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaaaaaaaaacaaaaaaaaaaaaaaaaaaaaaaaaaaaaaaaaaaaaaaaaaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733776 - DNA, 1423 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagggaggattgcaaacgtgcatgtgcaaaaaaaaaaacaaaaaaaaaaaaaaaaaaaaaaaaaaaaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733777 - DNA, 990 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatacagaacctgtgatgctttcacctatactggctgtggagggaatgacaataactttgttacagtccaaaagatgagggactgtgctctgccaatgtgactcgctattattttaatccaagatacagaacctgtgatactttcacctatactggctgtggagggaatgacaataactttgttagcagtgaaatggaaactgggatcctctagacgccacc

SEQ ID NO: 733778 - DNA, 803 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatgacgactgacacggccatagagcgactgacag

SEQ ID NO: 733779 - DNA, 880 bp, Homo sapiens
  misc_feature (796)..(796): n is a, c, g, or t
  misc_feature (824)..(824): n is a, c, g, or t
  misc_feature (865)..(865): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgactcgctattattttaatccaagatgtgaaattggccctttcaccctaantactgggctggtgggaaggggaaatgancaaattaaactttggttaagccaagggggagggaattggcnaaaaccgttgccatg

SEQ ID NO: 733780 - DNA, 3051 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatcacaaaagaaaaagcatttctttaagcattcaaacccaaatgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgcagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 733781 - DNA, 1726 bp, Homo sapiens
  misc_feature (1710)..(1710): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgaaaaaaaaaaaaaaaaacaaaaaaaaaaaaaaaacacaaacaacacaacaaagaaaanaaacaaaaaaaaagaa

SEQ ID NO: 733782 - DNA, 1811 bp, Homo sapiens
  misc_feature (1687)..(1687): n is a, c, g, or t
  misc_feature (1692)..(1692): n is a, c, g, or t
  misc_feature (1697)..(1697): n is a, c, g, or t
  misc_feature (1775)..(1775): n is a, c, g, or t
  misc_feature (1788)..(1788): n is a, c, g, or t
  misc_feature (1807)..(1807): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgaaaaaaaaaaaaaaaaacaaaaaaaaaaaaaattncctgnggccncaggctttttccctttggtgggggttatttttggcttggccctggccgtccgttttccaccgtcgtgcctgggggaanccccggggggttnccccacctttttccccttnacgg

SEQ ID NO: 733783 - DNA, 2073 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgaaaaaaaaaaaaaaaaacaaaaaaaaaaaaaactttgttggggggcttgggccttggaaaaagtttttaaaacccattcgttgttggggggggggccccagtattgtactgtggaccatgcgccaaaggcgtgcttcaaaaggaaaacccggcgccagtgacataggcggctgggggtgtctccccagataaataaaaccgccgggcgcgacacccggggcttttttagaccaatccccgaaggggagacgcggaggagcccaagacgggcgctctaacaaccaggggagtccagagggagcgcgaaataaaatagcggcgcgcgcgtgcggtgagaaacgaacacgtgcacgaccaacgaagaagacaagaggagaaaaacaaaagaacacaagaaaaagcggaaccatacacaacaaag

SEQ ID NO: 733784 - DNA, 1760 bp, Homo sapiens
  misc_feature (1744)..(1744): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgaaaaaaaaaaaacaaaaaaacaaaaaaaaaaaaaaaaaaaaaaaaaacaaacaaaaaaacaaacaaaacacaaacaacacaacaaagaaaanaaacaaaaaaaaagaa

SEQ ID NO: 733785 - DNA, 1155 bp, Homo sapiens
  misc_feature (1139)..(1139): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagcgagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaagtaaatacgatttttatgttccatcattttgctacagtccaaaagatgagggactgtgctctgccaatgtgatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaaaaaaacaaaaaaaaaaaaaaaaaaaaaaaaaaaaaaaaaaaaaacaaaaaaaaaaaaaaaacacaaacaacacaacaaagaaaanaaacaaaaaaaaagaa

SEQ ID NO: 733786 - DNA, 876 bp, Homo sapiens
catcagtttgacataagattctactaaactagtttcaacattagaataaggaaaggaaaattcctactttgtaaaaatcatattattctgatttcatcaccaacctcacagttttccaggcatatgtagaagaagtaattataatgccaaagtatgaaatatagccggtttcataaccggaatgaattatggctaattctcctgcagtaaataatttgtttttcaaatctgtattccccagacagctgagccaggccttgcttctcaagtgttttatttaaataggcagtatgtcagtggagttttaccacagagtttctgagcgcagagagcctttccctaggagtggggtgcagggaactggagggcaatggttcttatgagaaggtgatgatgcttctaagaaaaaagattacacaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaa

SEQ ID NO: 733787 - DNA, 625 bp, Homo sapiens
catcagtttgacataagattctactaaactagtttcaacattagaataaggaaaggaaaattcctactttgtaaaaatcatattattctgatttcatcaccaacctcacagttttccaggcatatgtagaagaagtaattataatgccaaagtatgaaatatagccggtttcataaccggaatgaattatggctaattctcctgcagtaaataatttgtttttcaaatctgtattccccagacagctgagccaggccttgcttctcaagtgttttatttaaataggcagtatgtcagtggagttttaccacagagtttctgagcgcagagagcctttccctaggagtggggtgcagggaactggagggcaatggttcttatgagaaggtgatgatgcttctaagaaaaaagattacacgtaagttaatacctaaccattttttttaattctgaaattcaaatgttctgcattttgaaatagaatgaatattctctaactttttagtctaaaaaatttccaagctggagctaccactcatccttggaactgccaattcctaagcattttcatgctggcactgaatgttgcattgactagccattcctatgtgcagtttctaatgct

SEQ ID NO: 733788 - DNA, 1808 bp, Homo sapiens
caggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgttgagagagataccctctcagactttacacagctaccaaggcaacaatgccaggaaaactattaatcaagatatgatagttcctgtttgcaatcaggagaagaaagcaaagaacactcaggattataaaagcagatgagacctacccactagacctggtcagacacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaggtactgataagcaacctgagaaatgtggtggaggctcagtttgatagccgggttcgtgcaacaggacacagttatgagaagtacaacaagtgggaaacgatagaggcttggactcaacaagtcgccactgagaatccagccctcatctctcgcagtgttatcggaaccacatttgagggacgcgctatttacctcctgaaggttggcaaagctggacaaaataagcctgccattttcatggactgtggtttccatgccagagagtggatttctcctgcattctgccagtggtttgtaagagaggctgttcgtacctatggacgtgagatccaagtgacagagcttctcgacaagttagacttttatgtcctgcctgtgctcaatattgatggctacatctacacctggaccaagagccgattttggagaaagactcgctccacccatactggatctagctgcattggcacagaccccaacagaaattttgatgctggttggtgtgaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttgaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaa

SEQ ID NO: 733789 - DNA, 815 bp, Homo sapiens
gtgttgagagagataccctctcagactttacacagctaccaaggcaacaatgccaggaaaactattaatcaagatatgatagttcctgtttgcaatcaggagaagaaagcaaagaacactcaggattataaaagcagatgagacctacccactagacctggtcagacacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaa

SEQ ID NO: 733790 - DNA, 430 bp, Homo sapiens
gtgagtcttggcttcagaactgtgcaaagaaccatgtgcctaaaaagccaacgaaagatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaa

SEQ ID NO: 733791 - DNA, 998 bp, Homo sapiens
gatccggtgggagggaacatctggaacattagacaggatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatgggcttcatagacaaaggagatgagagctgggtgacagacatgtgcaaggtaggagccagctctgatccctgtggccagctgaggccaacacttctgctaacatctctgcatcactttatgcactcaagaaatctttacatattaggtaactttatgcaattaaaatgcttctcttcacaaaaattaaaatgcctttccatgtttccgcactacatttgcacactgaagcaaccacatttgctgttagaaaagtactcctactacctaatttctggttaaaccaaggcctgatgttttctgcttccatttgtagtgagggtactttgtatcctataagcgagggactataggggtttctttgttcaaatttttcccacatccctgagaggctgacatgtgttgctgtgaccacttaattgatcccagcactttgggaggccaaggtggatggatcacctgaggtcaggagttcgagaccagcctggcgaacatggtgaaaccctatctctactaatgatacaaaaatcagcctgttgtggtggcaggctcttgtagtcccagctacttgggaggctgaggcaggaaaattgcttgaacccaggaggcaaaggttgcaatgagccaatattgtgccactacactccagcctgggcaacagagtgagactccatctcaaaa

SEQ ID NO: 733792 - DNA, 1509 bp, Homo sapiens
gatccggtgggagggaacatctggaacattagacaggatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatgggcttcatagacaaaggagatgagagctgggtgacagacatgtgcaagaaactgttcgaggtggaggaggtgaactgcatctgcgtggactggaagaagggctcccaagccacctacacacaggctgccaacaacgtgcgagtggtgggcgcccaggtggcccagatgctcgacatcctcttgacagagtatagctaccccccttccaaagttcacctcattggccacagcctgggagcccacgtggctggagaggcaggaagcaagactccaggcctgagcaggattacagggttggatcctgtagaagcaagtttcgagagtactcctgaagaggtgcgacttgatccctctgatgctgactttgttgatgtgattcacacggatgcagctcccctgatcccattcttgggttttggaacgaaccaacagatgggtcatcttgacttcttccccaatggaggagagagcatgccgggatgcaagaagaatgccctgtctcagatcgtggatctagatggcatctgggcgggaacccgggactttgtggcttgcaatcacctaagaagctacaagtattacttggaaagcatcctcaatcccgatgggtttgctgcatatccctgcacttcctacaagtcctttgagtctgacaagtgcttcccgtgtccagatcaaggatgcccacagatgggtcactatgctgataaatttgctggcaggacaagtgaagagcagcagaaattcttcttgaacacaggagaggctagcaatttcgctcgctggagatatggggtttccatcacactgtctggaagaacagccactggtcagatcaaagttgctttgtttggaaataagggaaacactcaccagtacagcatcttcagggggattctcaaaccaggctcaacccattcctatgagtttgatgcaaagctggatgttggaacaattgagaaagtcaagtttctttggaataacaatgtgataaatccaaccctccccaaagtgggtgccaccaagatcactgtgcaaaagggagaagagaagacagtgtacaacttctgtagcgaagacacagtgcgggaagacacgctgctcaccctcacgccctgctaagctcccggggcgacgaggctgctgcgttcacactaataaaatccactggtgcatctgtaaaaaatgg

SEQ ID NO: 733793 - DNA, 877 bp, Homo sapiens
tcctacacccctgccagcggcaccatggctttcctctggctcctctcctgcttctcccttgtgggggccgcctttggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggtgactctggaggccccctggtctgccagaaggacggagcctggaccctggtgggcattgtgtcctggggcagccgcacctgctctaccaccacgcccgctgtgtacgcccgtgtcaccaagctcataccctgggtgcagaagatcctggccgccaactgagcccgcagctcctgccacccctgccttaagatttcccattaaatgcatctgtttagaaaaa

SEQ ID NO: 733794 - DNA, 743 bp, Homo sapiens
tcctacacccctgccagcggcaccatggctttcctctggctcctctcctgcttctcccttgtgggggccgcctttggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgggtgactctggaggccccctggtctgccagaaggacggagcctggaccctggtgggcattgtgtcctggggcagccgcacctgctctaccaccacgcccgctgtgtacgcccgtgtcaccaagctcataccctgggtgcagaagatcctggccgccaactgagcccgcagctcctgccacccctgccttaagatttcccattaaatgcatctgtttagaaaaa

SEQ ID NO: 733795 - DNA, 904 bp, Homo sapiens
  misc_feature (1)..(1): n is a, c, g, or t
ngtcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaat

SEQ ID NO: 733796 - DNA, 335 bp, Homo sapiens
  misc_feature (1)..(1): n is a, c, g, or t
ngtcctatcatcacaaaactcatgatgctccggctgctcagttccctcctccttgtggccgttgcctcaggctatggcccaccttcctcccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaattcaaaaaaaaaaaaaaaaaaaaaaaaaaaaaac

SEQ ID NO: 733797 - DNA, 937 bp, Homo sapiens
  misc_feature (1)..(1): n is a, c, g, or t
ngtcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaattcaaaaaaaaaaaaaaaaaaaaaaaaaaaaaac

SEQ ID NO: 733798 - DNA, 985 bp, Homo sapiens
  misc_feature (1)..(1): n is a, c, g, or t
ngtcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagggaggatagagagacatgccagacaagaggctgcctggtgggggacagaccatagcaagccactagaaccaaggcccagctggcagtgctgatcgatcccacatcctgaataaagaataaagatctctcagaaaattcaaaaaaaaaaaaaaaaaaaaaaaaaaaaaac

SEQ ID NO: 733799 - DNA, 882 bp, Homo sapiens
  misc_feature (1)..(1): n is a, c, g, or t
ngtcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaattcaaaaaaaaaaaaaaaaaaaaaaaaaaaaaac

SEQ ID NO: 733800 - DNA, 930 bp, Homo sapiens
  misc_feature (1)..(1): n is a, c, g, or t
ngtcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagggaggatagagagacatgccagacaagaggctgcctggtgggggacagaccatagcaagccactagaaccaaggcccagctggcagtgctgatcgatcccacatcctgaataaagaataaagatctctcagaaaattcaaaaaaaaaaaaaaaaaaaaaaaaaaaaaac

SEQ ID NO: 733801 - DNA, 849 bp, Homo sapiens
  misc_feature (1)..(1): n is a, c, g, or t
ngtcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaat

SEQ ID NO: 733802 - DNA, 657 bp, Homo sapiens
  misc_feature (1)..(1): n is a, c, g, or t
ngtcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaattcaaaaaaaaaaaaaaaaaaaaaaaaaaaaaac

SEQ ID NO: 733803 - DNA, 624 bp, Homo sapiens
  misc_feature (1)..(1): n is a, c, g, or t
ngtcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaat

SEQ ID NO: 733804 - DNA, 2727 bp, Homo sapiens
cctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacggaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggc

SEQ ID NO: 733805 - DNA, 2427 bp, Homo sapiens
cctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacggaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacct

SEQ ID NO: 733806 - DNA, 2857 bp, Homo sapiens
cctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacggaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtgggtatgtttgcactccgggccgtcgctccaggagagagaagcttgctcctgagcctcctccctgtgccaggcgtggtaccaagtgcttccccctgagcgtcctgaagctgcctcag

SEQ ID NO: 733807 - DNA, 2914 bp, Homo sapiens
cctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacggaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacagagcctcctcaacccagcctgcagcagccattacccacccgccaaggtgacaggagaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtgggtatgtttgcactccgggccgtcgctccaggagagagaagcttgctcctgagcctcctccctgtgccaggcgtggtaccaagtgcttccccctgagcgtcctgaagctgcctcag

SEQ ID NO: 733808 - DNA, 2784 bp, Homo sapiens
cctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacggaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacagagcctcctcaacccagcctgcagcagccattacccacccgccaaggtgacaggagaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggc

SEQ ID NO: 733809 - DNA, 2484 bp, Homo sapiens
cctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacggaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacagagcctcctcaacccagcctgcagcagccattacccacccgccaaggtgacaggagaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacct

SEQ ID NO: 733810 - DNA, 2248 bp, Homo sapiens
cctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtgggtatgtttgcactccgggccgtcgctccaggagagagaagcttgctcctgagcctcctccctgtgccaggcgtggtaccaagtgcttccccctgagcgtcctgaagctgcctcag

SEQ ID NO: 733811 - DNA, 2118 bp, Homo sapiens
cctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggc

SEQ ID NO: 733812 - DNA, 1818 bp, Homo sapiens
cctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacct

SEQ ID NO: 733813 - DNA, 898 bp, Homo sapiens; identical to SEQ ID NO: 50527

SEQ ID NO: 733814 - DNA, 1027 bp, Homo sapiens; identical to SEQ ID NO: 50528

SEQ ID NO: 733815 - DNA, 1074 bp, Homo sapiens
gcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733816 - DNA, 1150 bp, Homo sapiens
caatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733817 - DNA, 1034 bp, Homo sapiens
tgcgaggacagctggggagaaggggagctgtgactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733818 - DNA, 1092 bp, Homo sapiens
gcaagccaaaaccctgggcagactcaatccaaaaataaacaatcaaagagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctggactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcccccacccatctgggccccgggttcaagagagagcggggtctgatctcgtgtagccatatagagtttgcttctgagtgtctgctttgtttagtagaggtgggcaggaggagctgaggggctggggctggggtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733819 - DNA, 950 bp, Homo sapiens
  misc_feature (17)..(17): n is a, c, g, or t
ttggtgggcatctagangatccttcccgggtctgggtaggaagtcctcatcgctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733820 - DNA, 829 bp, Homo sapiens
  misc_feature (17)..(17): n is a, c, g, or t
ttggtgggcatctagangatccttcccgggtctgggtaggaagtcctcatcgctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcccccacccatctgggccccgggttcaagagagagcggggtctgatctcgtgtagccatatagagtttgcttctgagtgtctgctttgtttagtagaggtgggcaggaggagctgaggggctggggctggggtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733821 - DNA, 913 bp, Homo sapiens
tgcgaggacagctggggagaaggggagctgtgactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcccccacccatctgggccccgggttcaagagagagcggggtctgatctcgtgtagccatatagagtttgcttctgagtgtctgctttgtttagtagaggtgggcaggaggagctgaggggctggggctggggtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733822 - DNA, 953 bp, Homo sapiens
gcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcccccacccatctgggccccgggttcaagagagagcggggtctgatctcgtgtagccatatagagtttgcttctgagtgtctgctttgtttagtagaggtgggcaggaggagctgaggggctggggctggggtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733823 - DNA, 1029 bp, Homo sapiens
caatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcccccacccatctgggccccgggttcaagagagagcggggtctgatctcgtgtagccatatagagtttgcttctgagtgtctgctttgtttagtagaggtgggcaggaggagctgaggggctggggctggggtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733824 - DNA, 893 bp, Homo sapiens
  misc_feature (17)..(17): n is a, c, g, or t
ttggtgggcatctagangatccttcccgggtctgggtaggaagtcctcatcgctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733825 - DNA, 977 bp, Homo sapiens
tgcgaggacagctggggagaaggggagctgtgactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733826 - DNA, 1195 bp, Homo sapiens
ctctgagagcattgatgaggtcaggaagcctcctgttgggtagaggagcaactaagagactgaacttggcccccaccctgaggctcacaagcttgaattgcacctgagttccaaaggagaagttgacattcttccagaacatatgcccagtgtcttcaacttgagatggagctgggatgccaagtctgcaaatactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733827 - DNA, 1074 bp, Homo sapiens
ctctgagagcattgatgaggtcaggaagcctcctgttgggtagaggagcaactaagagactgaacttggcccccaccctgaggctcacaagcttgaattgcacctgagttccaaaggagaagttgacattcttccagaacatatgcccagtgtcttcaacttgagatggagctgggatgccaagtctgcaaatactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcccccacccatctgggccccgggttcaagagagagcggggtctgatctcgtgtagccatatagagtttgcttctgagtgtctgctttgtttagtagaggtgggcaggaggagctgaggggctggggctggggtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733828 - DNA, 1138 bp, Homo sapiens
ctctgagagcattgatgaggtcaggaagcctcctgttgggtagaggagcaactaagagactgaacttggcccccaccctgaggctcacaagcttgaattgcacctgagttccaaaggagaagttgacattcttccagaacatatgcccagtgtcttcaacttgagatggagctgggatgccaagtctgcaaatactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733829 - DNA, 931 bp, Homo sapiens
tgcgaggacagctggggagaaggggagctgtggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733830 - DNA, 602 bp, Homo sapiens
gcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733831 - DNA, 1017 bp, Homo sapiens
gcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733832 - DNA, 678 bp, Homo sapiens
caatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733833 - DNA, 1093 bp, Homo sapiens
caatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733834 - DNA, 1162 bp, Homo sapiens
gcaagccaaaaccctgggcagactcaatccaaaaataaacaatcaaagagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctggactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacat

SEQ ID NO: 733835 - DNA, 616 bp, Homo sapiens
tacggtcggagtcgcttttattgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733836 - DNA, 387 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatggacaacccaggagcatctagtccttcgatgtttacccagcgcaaggtgtacagatattagagtttctacag

SEQ ID NO: 733837 - DNA, 340 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggtgcgtgcaccaccttccaccctgcgcactggggtccctactctgagctgctgggcgggtgggagtcgcttgggggacaggactctgctcccctgcttcccctcctccccgtctcctcacactgccct

SEQ ID NO: 733838 - DNA, 603 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733839 - DNA, 672 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagtctctcccccacctcccaccttccctagagctgggggctgctcccacctgaaggcccccatcccacaggccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733840 - DNA, 400 bp, Homo sapiens
tacggtcggagtcgcttttattgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatggacaacccaggagcatctagtccttcgatgtttacccagcgcaaggtgtacagatattagagtttctacag

SEQ ID NO: 733841 - DNA, 715 bp, Homo sapiens
tacggtcggagtcgcttttattgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtgaggctgcccagccccttcaatactcatccccagcaccttctctgggccttcacccatgacccagagcccagtaccagtgaggcagttgctggaagggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733842 - DNA, 702 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtgaggctgcccagccccttcaatactcatccccagcaccttctctgggccttcacccatgacccagagcccagtaccagtgaggcagttgctggaagggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733843 - DNA, 771 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagtctctcccccacctcccaccttccctagagctgggggctgctcccacctgaaggcccccatcccacaggccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtgaggctgcccagccccttcaatactcatccccagcaccttctctgggccttcacccatgacccagagcccagtaccagtgaggcagttgctggaagggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733844 - DNA, 643 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaaagctgggggctgctcccacctgaaggcccccatcccacaggccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733845 - DNA, 742 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaaagctgggggctgctcccacctgaaggcccccatcccacaggccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtgaggctgcccagccccttcaatactcatccccagcaccttctctgggccttcacccatgacccagagcccagtaccagtgaggcagttgctggaagggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733846 - DNA, 708 bp, Homo sapiens
tacggtcggagtcgcttttattgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgaccaacccttcctgcgccatgggagcctccgtacccaccttcctgtgcagtcactcccccgcagtttctgctcagaccctcctcaccccccaggttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733847 - DNA, 442 bp, Homo sapiens
  misc_feature (366)..(366): n is a, c, g, or t
  misc_feature (373)..(373): n is a, c, g, or t
  misc_feature (380)..(380): n is a, c, g, or t
  misc_feature (383)..(383): n is a, c, g, or t
  misc_feature (390)..(390): n is a, c, g, or t
  misc_feature (401)..(401): n is a, c, g, or t
tacggtcggagtcgcttttattgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatggacaaccccaggagcatctgagtcctccgatgtttcnccagcgnaagggtngtnacagatngttagcgtttnctaccagagaaagttctcccctagggggcgatttgccctaa

SEQ ID NO: 733848 - DNA, 695 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgaccaacccttcctgcgccatgggagcctccgtacccaccttcctgtgcagtcactcccccgcagtttctgctcagaccctcctcaccccccaggttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733849 - DNA, 429 bp, Homo sapiens
  misc_feature (353)..(353): n is a, c, g, or t
  misc_feature (360)..(360): n is a, c, g, or t
  misc_feature (367)..(367): n is a, c, g, or t
  misc_feature (370)..(370): n is a, c, g, or t
  misc_feature (377)..(377): n is a, c, g, or t
  misc_feature (388)..(388): n is a, c, g, or t
cacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatggacaaccccaggagcatctgagtcctccgatgtttcnccagcgnaagggtngtnacagatngttagcgtttnctaccagagaaagttctcccctagggggcgatttgccctaa

SEQ ID NO: 733850 - DNA, 764 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagtctctcccccacctcccaccttccctagagctgggggctgctcccacctgaaggcccccatcccacaggccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgaccaacccttcctgcgccatgggagcctccgtacccaccttcctgtgcagtcactcccccgcagtttctgctcagaccctcctcaccccccaggttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733851 - DNA, 735 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaaagctgggggctgctcccacctgaaggcccccatcccacaggccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgaccaacccttcctgcgccatgggagcctccgtacccaccttcctgtgcagtcactcccccgcagtttctgctcagaccctcctcaccccccaggttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733852 - DNA, 531 bp, Homo sapiens
cttgcttccacttcaccttcccgacccacagctgcctctgcccctccagcccctgtggccaggatggagggagggcggcctgggccttctgggggacacccagggtccctgtgtgcacctcatgccccacccccaccagggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733853 - DNA, 630 bp, Homo sapiens
cttgcttccacttcaccttcccgacccacagctgcctctgcccctccagcccctgtggccaggatggagggagggcggcctgggccttctgggggacacccagggtccctgtgtgcacctcatgccccacccccaccagggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtgaggctgcccagccccttcaatactcatccccagcaccttctctgggccttcacccatgacccagagcccagtaccagtgaggcagttgctggaagggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733854 - DNA, 469 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctgggtgaggctgcccagccccttcaatactcatccccagcaccttctctgggccttcacccatgacccagagcccagtaccagtgaggcagttgctggaagggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733855 - DNA, 623 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaagtctctcccccacctcccaccttccctagagctgggggctgctcccacctgaaggcccccatcccacaggccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 733856 - DNA, 240 bp, Homo sapiens
cacacctctgcagagagaatggccagcaggaaggcggggacccggggcaaggtggcagccaccaagcaggcccaacgtggttcttccaacgtcttttccatgtttgaacaagcccagatacaggagttcaaagaaggaaggtgagtgtcccagaggaggagctggacgccatgctgcaagagggcaagggccccatcaacttcaccgtcttcctcacgctctttggggagaagctcaatg

SEQ ID NO: 733857 - DNA, 289 bp, Homo sapiens; identical to SEQ ID NO: 445568

SEQ ID NO: 733858 - DNA, 647 bp, Homo sapiens
  misc_feature (164)..(164): n is a, c, g, or t
  misc_feature (479)..(479): n is a, c, g, or t
  misc_feature (503)..(503): n is a, c, g, or t
  misc_feature (514)..(514): n is a, c, g, or t
gcggacttcgacacctacgacgatcgggcctacagcagcttcggcggcggcagagggtcccgcggcagtgctggtggccatggttcccgtagccagaaggagttgcccacagagcccccctacacagcatactgtaggaaatctacctttcaatacggttcagnggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttctatagggggcaggggaggtagtcgcccaggcgaccggctgaacaggcccccccnatgggcagccgcttcagagatggncctcccctccngtggatccaacatggatttcagagaaccacagaagaggaaagagccatgggaccgacgatcccgctgaagctcaacagtcgaagcccctcatcagtaggcatcccaacctgcaaaacgaggggcaggctaaaa

SEQ ID NO: 733859 - DNA, 957 bp, Homo sapiens
  misc_feature (164)..(164): n is a, c, g, or t
  misc_feature (479)..(479): n is a, c, g, or t
  misc_feature (505)..(506): n is a, c, g, or t
  misc_feature (520)..(520): n is a, c, g, or t
  misc_feature (533)..(533): n is a, c, g, or t
  misc_feature (582)..(582): n is a, c, g, or t
  misc_feature (588)..(588): n is a, c, g, or t
  misc_feature (600)..(600): n is a, c, g, or t
  misc_feature (608)..(609): n is a, c, g, or t
  misc_feature (621)..(621): n is a, c, g, or t
  misc_feature (683)..(683): n is a, c, g, or t
  misc_feature (690)..(690): n is a, c, g, or t
  misc_feature (692)..(692): n is a, c, g, or t
  misc_feature (728)..(728): n is a, c, g, or t
  misc_feature (745)..(745): n is a, c, g, or t
  misc_feature (748)..(748): n is a, c, g, or t
  misc_feature (758)..(758): n is a, c, g, or t
  misc_feature (780)..(780): n is a, c, g, or t
  misc_feature (800)..(800): n is a, c, g, or t
  misc_feature (802)..(803): n is a, c, g, or t
  misc_feature (811)..(811): n is a, c, g, or t
  misc_feature (846)..(846): n is a, c, g, or t
  misc_feature (957)..(957): n is a, c, g, or t
gcggacttcgacacctacgacgatcgggcctacagcagcttcggcggcggcagagggtcccgcggcagtgctggtggccatggttcccgtagccagaaggagttgcccacagagcccccctacacagcatactgtaggaaatctacctttcaatacggttcagnggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttctatagggggcaggggaggtagtcgcccaggcgaccggctgaacaggcccccccnatgggcagccgcttcaaaaatagaanncccataaaataganaaaaaatagattnaaaaaaacccacagaagaggaaagagcacagagaccacgactccagctnaaaccncgaacagtcgcnacgccccnnaatcaagtagcnaatcccaactctgctatcttcggggggtgccaggcctagagaggaagtcgttcaaaaagagnaagaatnancctgcggttgggagggaatggggcgtggggggttanaacaagaccacagcctnggngagtcccagngcaaccgtcctgcagccgccantcctgcgcctgccattggcntnnaaaaaaangaaacacagcttgtgagtgcatgtcagctgttaanaagtggtttttagtacattctgggctttgctgtatctatctaatgcctgtttgtgcgtttttttctttcttccgctgcttccccattttcttctgtcctttttctcctgcn

SEQ ID NO: 733860 - DNA, 707 bp, Homo sapiens
  misc_feature (164)..(164): n is a, c, g, or t
  misc_feature (539)..(539): n is a, c, g, or t
  misc_feature (563)..(563): n is a, c, g, or t
  misc_feature (574)..(574): n is a, c, g, or t
gcggacttcgacacctacgacgatcgggcctacagcagcttcggcggcggcagagggtcccgcggcagtgctggtggccatggttcccgtagccagaaggagttgcccacagagcccccctacacagcatactgtaggaaatctacctttcaatacggttcagnggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggaatgggtagctctcgagaatctagaggtggatgggattcccgggatgacttcagttctggcttcagggatgacttctatagggggcaggggaggtagtcgcccaggcgaccggctgaacaggcccccccnatgggcagccgcttcagagatggncctcccctccngtggatccaacatggatttcagagaaccacagaagaggaaagagccatgggaccgacgatcccgctgaagctcaacagtcgaagcccctcatcagtaggcatcccaacctgcaaaacgaggggcaggctaaaa

SEQ ID NO: 733861 - DNA, 1547 bp, Homo sapiens
atcctgtgcggcgcgcgtgggcaggtcattgcagttgggcgctcagcagctgtggcagccggttgaggtctggaagtagcgttgggctgaagcagcggagttcgccatgcgcgagtgtatctctatccacgtggggcaggcgggtgtccagatcggcaatgcctgctgggaactgtactgccttgaacatggaattcagcccgatggtcaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccagagcagctgatcaccgggaaggaagatgcagccagtaattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacagcaagaagtccaagctagagtttgccatttacccaggcccccaggtctccacagccgtggtggagccctacaactccatcctaaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacggcctccctgcgatttgatggggccctgaatgtggacttgacggaattccagaccaacctcgtgccgtacccccgcatccacttccccctggccacctacgccccagtcatctcagctgagaaggcctaccacgagcagctgtctgtggctgagatcaccaatgcctgcttcgagccagccaatcagatggtcaagtgtgaccctcgccatggcaagtacatggcctgctgcatgttgtacaggggggacgtggtccccaaagacgtcaatgcggccatcgccaccatcaagaccaagcgcactatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggtccataagttcgatctcatgtatgccaagtgggcctttgtgcactggtacgtgggcgaaggcatggaagagggagagttctctgaggcccgcgaggacctggcagctctagagaaggattgtgaagaggtgggcgtggattccgtggaagctgaggctgaagaaggcgaagaatactgaggggagggtgtggtgggttctcccctgccacccctaggatggctgctttcaagttgtttgcaattaaagattctgtataaaaccaaga

SEQ ID NO: 733862 - DNA, 1061 bp, Homo sapiens; identical to SEQ ID NO: 728853

SEQ ID NO: 733863 - DNA, 553 bp, Homo sapiens; identical to SEQ ID NO: 456541

SEQ ID NO: 733864 - DNA, 460 bp, Homo sapiens; identical to SEQ ID NO: 456544
  misc_feature (42)..(42): n is a, c, g, or t

SEQ ID NO: 733865 - DNA, 595 bp, Homo sapiens
gacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaagatgtgtgtacagtgtccacaggcatcacaccttcttcattaaaaacccagtttcctggtca

SEQ ID NO: 733866 - DNA, 532 bp, Homo sapiens
gacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcagtgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtca

SEQ ID NO: 733867 - DNA, 1033 bp, Homo sapiens
gacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtca

SEQ ID NO: 733868 - DNA, 751 bp, Homo sapiens
gacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtca

SEQ ID NO: 733869 - DNA, 507 bp, Homo sapiens
cgagaagctgaggttttgtaggagcccttatgaatgaagatccagtccggggtgcgctagggctgagaagccctggggactgcatgtgctgtaggtaagtcagggattcatgcgctgcacacaggtccccgggaactgatggctttgcctctttgtccctacaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcaacctttcctccagccctgtgccacactccttctatgtgtgtacagtgtccacaggcatcacaccttcttcattaaaaacccagtttcctggtca

SEQ ID NO: 733870 - DNA, 414 bp, Homo sapiens
  misc_feature (42)..(42): n is a, c, g, or t
gggggggggggagggggcccatacggcgttgcgtagcgacgncgagctcgctgtctccgacctcacagagagccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcaacctttcctccagccctgtgccacactccttctatgtgtgtacagtgtccacaggcatcacaccttcttcattaaaaacccagtttcctggtca

SEQ ID NO: 733871 - DNA, 987 bp, Homo sapiens
gacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcaacctttcctccagccctgtgccacactccttctatgtgtgtacagtgtccacaggcatcacaccttcttcattaaaaacccagtttcctggtca

SEQ ID NO: 733872 - DNA, 890 bp, Homo sapiens
gacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagttgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtca

SEQ ID NO: 733873 - DNA, 844 bp, Homo sapiens
gacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagttgcatgccctcctctggaactgggattaaacagatacccaagaggcaggaaaaacgcgagtgtctgaagacctcaccctggcagggtgggcttctatccacccatgaggcacctggggcttctcaacctttcctccagccctgtgccacactccttctatgtgtgtacagtgtccacaggcatcacaccttcttcattaaaaacccagtttcctggtca

SEQ ID NO: 733874 - DNA, 807 bp, Homo sapiens
gacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggtccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtca

SEQ ID NO: 733875 - DNA, 412 bp, Homo sapiens
  misc_feature (341)..(341): n is a, c, g, or t
  misc_feature (351)..(351): n is a, c, g, or t
  misc_feature (363)..(363): n is a, c, g, or t
cggcacgagctggagcagacgcctccaggatctgtcggcagctgctgttctgagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctccaagatccccgatggagagagatggactttgatgacatccaccngaagcgcatngagaaggacctnaattagttgcaggcgctgattgaggctactttgagaacacggagaaaga

SEQ ID NO: 733876 - DNA, 471 bp, Homo sapiens
  misc_feature (182)..(182): n is a, c, g, or t
  misc_feature (223)..(223): n is a, c, g, or t
cggcacgagctggagcagacgcctccaggatctgtcggcagctgctgttctgagggagagcagagaccatgtctgacatagaagaggtggtggaagagtacgaggaggaggagcaggaagaagcagctgttgaagaagaggaggacttgagagaggacgaagacgagcaggaggaggcagcngaagaggattcttaagcagaggcttagacccaggagaccanggcagaagaagattaagaagaagaggcagactgagcgggaaaagaagaagaagattctggcttagaaggaggaaggttctggccattaccaccttaattaagatcaacttagggagaaggccaaggagctttggcaaacatctataacttggaggcgaaaagttcacctccagagagttcagcagcgaattttagatcattttctccaacaggatcacgataccagaagtctccaacccgcggaggct

SEQ ID NO: 733877 - DNA, 464 bp, Homo sapiens
  misc_feature (393)..(393): n is a, c, g, or t
  misc_feature (403)..(403): n is a, c, g, or t
  misc_feature (415)..(415): n is a, c, g, or t
gattccccctaagcctcgctgatctctgtacaacgggggccagagcctcctctgaggaaggcaggcttccctttgtacctgcactgacttttttctccttttggagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctccaagatccccgatggagagagatggactttgatgacatccaccngaagcgcatngagaaggacctnaattagttgcaggcgctgattgaggctactttgagaacacggagaaaga

SEQ ID NO: 733878 - DNA, 442 bp, Homo sapiens
  misc_feature (371)..(371): n is a, c, g, or t
  misc_feature (381)..(381): n is a, c, g, or t
  misc_feature (393)..(393): n is a, c, g, or t
cggcacgagctggagcagacgcctccaggatctgtcggcagctgctgttctgagggagagcagagaccatgtctgacatagaagaggtggtggaagagtacgaggaggaggagcaggaagaagcagctgttgaagaagaggaggacttgagagaggacgaagacgagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctccaagatccccgatggagagagatggactttgatgacatccaccngaagcgcatngagaaggacctnaattagttgcaggcgctgattgaggctactttgagaacacggagaaaga

SEQ ID NO: 733879 - DNA, 801 bp, Homo sapiens
gctggagtgcaatggtgccatcttggctcactacaacctccgcctcccaggttcaagggattctgcctcagcctcctgagtaactggggttacaggcgcgcgataccacgcctggctaatttttctatttttagtagagatggggtttcgccatgttggccacgctggtcttaaactcctgacctcaagtgatccgcccgccttggtcttccaaagtgctgggattacaggtgtgagtcaccgtgcccagcctggacttgccttttacctcatccgtggtgtcttttgaagaaaaagattctttagaaatgttttttctttcatagcttgtgttttatgtattactttcaagatcccaactagatctaggtcctaaaaatagtatcctacctattgtttttttaatcaacttaattgtggtataattgcacactgcagataaactgcacatgtttgaagtgagtaatgtaagtttttttgtcttggagccctgaggtaaacttttatttcttagctgacaggacttccacacccatgctcctctcggcacctttcacccagcccaagcagcggcggcccagtggtggaaaaggtgccacggccaaacggattggagactcaccccgcattctaggccggagaagcgggcgggcttgggatgccggcaggaggcaatgactctccccaggcgctgcatcctggctccggggcacaagcgcctctccgccctgacgctgatgctcgtctggctgcccgttctttggcatcaaaataccagacgatggtggcgcaccctgtggc

SEQ ID NO: 733880 - DNA, 613 bp, Homo sapiens
gaaggatcatacatcactcaatcatcagcaaacatttatgaagcacctgctctcgtgcccagcctggacttgccttttacctcatccgtggtgtcttttgaagaaaaagattctttagaaatgttttttctttcatagcttgtgttttatgtattactttcaagatcccaactagatctaggtcctaaaaatagtatcctacctattgtttttttaatcaacttaattgtggtataattgcacactgcagataaactgcacatgtttgaagtgagtaatgtaagtttttttgtcttggagccctgaggtaaacttttatttcttagctgacaggacttccacacccatgctcctctcggcacctttcacccagcccaagcagcggcggcccagtggtggaaaaggtgccacggccaaacggattggagactcaccccgcattctaggccggagaagcgggcgggcttgggatgccggcaggaggcaatgactctccccaggcgctgcatcctggctccggggcacaagcgcctctccgccctgacgctgatgctcgtctggctgcccgttctttggcatcaaaataccagacgatggtggcgcaccctgtggc

SEQ ID NO: 733881 - DNA, 3001 bp, Homo sapiens
atttcaattaaagtttgtaattatgtgccatgttggtgtgctgcacccattaactcgtcatttagcattaggtatatctcccaatgctatccctcccccgtcccccatcccacaacagtccccagtgtgtgatgttccccttcctgtgtccatgtgttctcatcgttcaattcccacctatgaatacaatgaaggcaagagggacacctgttgtacttctttagataaaccaacccttggtaggaagctgcccaacaaagggcccatgacactgaacacggcagcttcttggaccaagaacaattcctgtgagggattcaattgtgatccaacagcaagaaattctcctaaatatatctccaacagagtaaacaagagattaggaaacttgtccttcattcaattacacctggcaggtgaatgggagtggagcagtaagagatgctgcttccagtagttttctacctctcaatccttgctattcaaagtatggtccacagtccagcagctttggcatcacctgggaacttgatggaaatgcagataagttcaaattcccactactgatatactgaattagaaacatctgcccttcaagaagatccactggtgataatatgcatattaaagtttgagtagcaccgccattctatatcagcttgcaaaatgaaagcaagaagaaacaaaacaaagcattagccagtttggattttctgaagtgcactaaatgtcaaactcaagaaaaggtagtagaaaataaatttctcttcaaccaagtcattagtatggaatcatctactctgttttgaggcgacaccagccaataccagccacattttcggaatcatcattttctggtgaaataaactgacttgcataatttaataaattttggtgaataacaagacttactctcagataccaacatttcctagcttgcaagacagtagttatagaaggaaactaatagacatggtttaaaacaccttctaatgcaaagtagaagatttacaatgctgcttcattgtcaggttccagtgtcctccttttatccaacaaaatctaaagagttatctcattggaattttcagcttcagtgaaaattctgtgatgatctcaaatgttgctgcataaaatgtataattaatggagtgaagtggtttgtaaagaaacattttattagaacaagtgagggtaaatgaactaatagagttcaattctatgcttcaatttccaatataatatgcaaatatctactctgcaaaaccgtataaaacgactttctgaactattattctaggtttaatacagtgattagactgggtcatcatttctgcattgtcagaaactgtgctattttgcagtatctaattgttgttttatttcctttttaattattttattcactgtgttattattttggctttaacatcagacacattctttgatattaaaattgcatttgattagcttttaactgtctcagacatattaatacatgatgatgggttttaagtcaatgaatgtattcttctatgttatggcctatttcattgttctaattcgagtgtcaaaattgctatttatttgaggactgtcattatcaaatatttcagaatgtgagttgccattattcaaaggaataagtcaacagacatttacataacatgtaatagtaaaacgaaattattcatattataacgttttataatgtttggcttagaagacttgctacagatgttatagacaaacaaaaattgtatggttaatgcaacaggaacctggtttcagataggtgacatgacattttcaaagtctcacagcaattttgattgagctaagcctcaaccattggtcaatttctttagtcttttttttttaacactgaaatcaaccatgctatttctagcccccattttttaaacttggataatcaaaatgagtttaataaaacatcgtcaaccaaatatcacattatgcataataacacgtatcttgaaggttatagtaaatggaaagatgaatctggaaagctaagagaattagaggtcatggctggatgtaaaatcaccatggaaacagctttcatggccaatttgtggggatatgtcaaaaggcagtaacctgtgacttatttttttccaaagccctttctatgaaggttacaggctctatatctgctttcatgatgacatttgtctatgtttttgtaggattctattctgacaagcacaaaaccctgcaccaagttgaacctgtcctttgtgatgaggctgttgaacagaagagcagcgtagcagtctgtctattcttgctccacattcagctaaatgccaactccgatccctttgagatggtgaacaggctgaacccagggatcgtgtcatccctcagtatccagacttcttcagagaaccatgtggtgaaacttcttgattaaggtcgcaaaagaagagacaactatacattttgtgatgctgaagggaaatgtacaagagcactactgaagaagtccagccaaaaaaaaaaaaaaaaagcccagtagtattcttatcaagcctgtatatccagtttataggaaatataagagacagagacacatgttaaatggcaacagtagaatgtaatacacaaaatccagacttgaaaatgttataaaatatgcaaaaaagatttcttaagaataatattagaagaaaaatgagtttgtgggagaacttatagagtctttaaaaaatatattaattacagtgtatgaattcactttgtttcatgattcaaacaacaagctggttaaaagtttaagagaaaattccatcatgatattgactttgaatttttattagatttttcttgaaatctttttcactactttttattttctcacctttattcgggtataattgacaaaattgtatgtaagttgtacaacatgatgatttgatatgtgtacacattgtaaaataattaccacagtcaaattttttaacatattccttat

SEQ ID NO: 733882 - DNA, 603 bp, Homo sapiens
atgttgacagtcgctctcctagcccttctctgtgcctcagcctctggcaatgccattcaggccaggtcttcctcctatagtggagagtatggaagtggtggtggaaagcgattctctcattctggcaaccagttggacggccccatcaccgccctccgggtccgagtcaacacatactacatcgtaggtcttcaggtgcgctatggcaaggtgtggagcgactatgtgggtggtcgcaacggagacctggaggagatctttctgcaccctggggaatcagtgatccaggtttctgggaagtacaagtggtacctgaagaagctggtatttgtgacagacaagggccgctatctgtcttttgggaaagacagtggcacaagtttcaatgccgtccccttgcaccccaacaccgtgctccgcttcatcagtggccggtctggttctctcatcgatgccattggcctgcactgggatgtttaccccactagctgcagcagatgctgagcctcctctccttggcaggggcactgtgatgaggagtaagaactcccttatcactaacccccatccaaatggctcaataaaaaaatatggttaaggcta

SEQ ID NO: 733883 - DNA, 668 bp, Homo sapiens; identical to SEQ ID NO: 300990

SEQ ID NO: 733884 - DNA, 729 bp, Homo sapiens
  misc_feature (143)..(143): n is a, c, g, or t
  misc_feature (436)..(436): n is a, c, g, or t
  misc_feature (444)..(445): n is a, c, g, or t
  misc_feature (489)..(489): n is a, c, g, or t
  misc_feature (497)..(498): n is a, c, g, or t
  misc_feature (500)..(501): n is a, c, g, or t
  misc_feature (516)..(516): n is a, c, g, or t
  misc_feature (533)..(533): n is a, c, g, or t
  misc_feature (547)..(547): n is a, c, g, or t
  misc_feature (550)..(550): n is a, c, g, or t
  misc_feature (558)..(558): n is a, c, g, or t
  misc_feature (571)..(571): n is a, c, g, or t
  misc_feature (591)..(591): n is a, c, g, or t
  misc_feature (603)..(603): n is a, c, g, or t
  misc_feature (611)..(611): n is a, c, g, or t
  misc_feature (618)..(618): n is a, c, g, or t
  misc_feature (624)..(624): n is a, c, g, or t
  misc_feature (627)..(627): n is a, c, g, or t
  misc_feature (630)..(630): n is a, c, g, or t
  misc_feature (633)..(633): n is a, c, g, or t
  misc_feature (639)..(639): n is a, c, g, or t
  misc_feature (645)..(645): n is a, c, g, or t
  misc_feature (649)..(649): n is a, c, g, or t
gatcccagcatctcagagtgcagtcaagttccctcctgcagcctgccccctaggcagctcgagcatgccctgagctctctgaaagttgtcgccctggaatagggtcctgcagggtagaataaaaaggcccctgtggtcacttntcctgacacattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcanttctctgnntgatacggagccatgtcatgtgccacgacctggggtgggcacanggaggctnnannttcctgctgaacctngctgggcctatttgctnctagccacagaganagntgcccctnctgaacggccatncccagtgctccgtgcagganaggaacacccgnttgagagngtcccanccgacngcnttnttncatggntttatnaggnaaagacacccacccctcctggggtgtgaagacaaaacattgtccccctgaagggggaacccttggatattcccggggggg

SEQ ID NO: 733885 - DNA, 711 bp, Homo sapiens
  misc_feature (386)..(386): n is a, c, g, or t
  misc_feature (394)..(395): n is a, c, g, or t
  misc_feature (439)..(439): n is a, c, g, or t
  misc_feature (447)..(448): n is a, c, g, or t
  misc_feature (450)..(451): n is a, c, g, or t
  misc_feature (466)..(466): n is a, c, g, or t
  misc_feature (483)..(483): n is a, c, g, or t
  misc_feature (497)..(497): n is a, c, g, or t
  misc_feature (500)..(500): n is a, c, g, or t
  misc_feature (508)..(508): n is a, c, g, or t
  misc_feature (521)..(521): n is a, c, g, or t
  misc_feature (541)..(541): n is a, c, g, or t
  misc_feature (553)..(553): n is a, c, g, or t
  misc_feature (561)..(561): n is a, c, g, or t
  misc_feature (568)..(568): n is a, c, g, or t
  misc_feature (574)..(574): n is a, c, g, or t
  misc_feature (577)..(577): n is a, c, g, or t
  misc_feature (580)..(580): n is a, c, g, or t
  misc_feature (583)..(583): n is a, c, g, or t
  misc_feature (589)..(589): n is a, c, g, or t
  misc_feature (595)..(595): n is a, c, g, or t
  misc_feature (599)..(599): n is a, c, g, or t
gatcccagcatctcagagtgcagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgtttttggcaacaggagagacaggattgggccaacaaggactcagacgagttttattgactcanttctctgnntgatacggagccatgtcatgtgccacgacctggggtgggcacanggaggctnnannttcctgctgaacctngctgggcctatttgctnctagccacagaganagntgcccctnctgaacggccatncccagtgctccgtgcagganaggaacacccgnttgagagngtcccanccgacngcnttnttncatggntttatnaggnaaagatcacagcaggcacctcctggtggttgttaagatcagagccttttgtccccttgaaggggaaatccttatgcatcattccacgtggtcagtaaaccagaacccctgcc

SEQ ID NO: 733886 - DNA, 520 bp, Homo sapiens
  misc_feature (4)..(7): n is a, c, g, or t
  misc_feature (10)..(11): n is a, c, g, or t
atgnnnntgnnccaggggctgctgctgttgctgctgctgagcatgggcggggcatgggcatccagggagccgcttcggccatggtgccaccccatcaatgccatcctggctgtcgagaaggagggctgcccagtgtgcatcaccgtcaacaccaccatctgtgccggctactgccccaccatgatgcgcgtgctgcaggcggtcctgccgcccctgcctcaggtggtgtgcacctaccgtgatgtgcgcttcgagtccatccggctccctggctgcccgcgtggtgtggaccccgtggtctccttccctgtggctctcagctgtcgctgtggaccctgccgccgcagcacctctgactgtgggggtcccaaagaccaccccttgacctgtgaccacccccaactctcaggcctcctcttcctctaaagaccctccccgcagccttccaagtccatcccgactcctggagccctgacaccccgatcctcccacaataaaggcttctcaatccgcaaaaaga

SEQ ID NO: 733887 - DNA, 1768 bp, Homo sapiens
tgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactgggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaataaaaaaat

SEQ ID NO: 733888 - DNA, 1654 bp, Homo sapiens
ggggggcggtgccgttgggaccacggcggccagagcggcaggatggcttccggcttcaagaagcccagcgctgcctccaccggccaaaagagaaaggtggcacctaagcccgagctcactgaggatcagaagcaagaagttcgggaagcatttgacctcttcgacgtggacggaagtgggaccatcgacgcgaaggagctgaaggtggccatgagagcgctgggcttcgaacccaggaaggaagagatgaagaaaatgatctccgaggtggacagggaaggcacggggaagatcagcttcaatgacttcctggccgtgatgacgcagaagatgtccgagaaggacaccaaagaagaaatcctgaaggccttcaggctctttgatgacgatgagaccgggaagatctcgttcaaaaacctgaagcgtgtggccaacgagctgggggagaacctcacggatgaggagctgcaggagatgatcgacgaagctgatcgggatggggacggcgaagtgaacgaggaggagttccttcggatcatgaagaagaccagcctttactgaagtcggttcagaagctaaagtgactctctgggttgcctgcttccattttgtgaaaccttagaggacagcggctgcctgtcccttcttcaccccctcacccccataatttgtctagatctatttccatatctctagttcaataatagaatttgaaagatgcttgtaatgtgagttttgggttttaattctcaagagccaacctggagcacatgaggttaaacaaagggccctgaagtttgagtgcgccctccatttgccctgtgctgaacttgctgttcatctgttgatctggaggcaggacagcttctgggacacacaaaaatgtggttccctttgtcacttctttggtggtcttaaattatcttgcttcatatatcattccttaaattccagtcattgttccagcataatgagatggaatctgccagtagatttgcctagcctgtccacttagctgaataccagtttgaaggaaaacagggtggccacttacaaacttacggagctcaggacagatattcttataaagaatagacttgcttgggtggtagtacgttgtgcaattttgactattcactggctttatacctgcaaatgattcttcgttcatgtgtaaattgtccaccatgggtttatctagggctagtatgtatacctgggctacagaataaaaataaaatctaatactggcccaagcaaagtataatttgcttaagaggttacgctaacaaacgattttgagtaaatatttacaaatgtaggatcttagtttaggaaattataacaaataccttaatataacattttaagctacttatagtccttggaaatagcaacaaatatcttagttattggactattataaccttagtcatcttattactgcttgattatgagacactctccctgctaatccttagaacatcttggttcttggtacttgacttttagcccctctgacatatagttgatgtcagagtgtctggcatttcagtagtgctctattttacaaatcccagtaaactgctccactgtggcttgtttatgtgttaatactgcttgttttctgttataaattattttttgctttgga

SEQ ID NO: 733889 - DNA, 919 bp, Homo sapiens
  misc_feature (29)..(29): n is a, c, g, or t
  misc_feature (889)..(889): n is a, c, g, or t
  misc_feature (891)..(891): n is a, c, g, or t
  misc_feature (893)..(893): n is a, c, g, or t
ggaagcagggagagagaactggccagggnataaaaagggcccacaagagaccggctctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733890 - DNA, 299 bp, Homo sapiens
  misc_feature (293)..(294): n is a, c, g, or t
gcccgagttagaggggctgcaagaagaaggtcgtccacatatgaagatgactgggagacaggtttaaggaagtgaggtttcgggctagagcttgtccaaagaaatgagggctatccctgaagccctgagggaggacagtccatgtgagttgttgtgactggagggtgtcagggtcagtccaggtgaaagcaaataggtgcccgagtagcatcctgtgacccctccccagtgcctctcctggccctgaaggtgccactccatgtgcccaccatgcccggtgtaccggagctcgnnaattc

SEQ ID NO: 733891 - DNA, 651 bp, Homo sapiens
  misc_feature (19)..(19): n is a, c, g, or t
  misc_feature (183)..(183): n is a, c, g, or t
caggtctgtgcgtactagngatgtcagtccgacgtccttgtctggtttgcctgtctgctgcctggttcaagagctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcaacgtctatgacctcctaaaagtacctaaaggcagggctccacaagctgattgcgccgctgtgccgattgcaacccccgtgactgggccgatctttcaaacagacctacaacaagttcgacaccaacccaacaacactgacgccccaaatccaaccaacgggcttatccgctaacgacggacacggccaggccactccccagcaccggccacgccgcacgccgccggcaccacagcgacccgc

SEQ ID NO: 733892 - DNA, 802 bp, Homo sapiens
  misc_feature (19)..(19): n is a, c, g, or t
  misc_feature (772)..(772): n is a, c, g, or t
  misc_feature (774)..(774): n is a, c, g, or t
  misc_feature (776)..(776): n is a, c, g, or t
caggtctgtgcgtactagngatgtcagtccgacgtccttgtctggtttgcctgtctgctgcctggttcaagagctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733893 - DNA, 919 bp, Homo sapiens
  misc_feature (29)..(29): n is a, c, g, or t
  misc_feature (270)..(270): n is a, c, g, or t
  misc_feature (889)..(889): n is a, c, g, or t
  misc_feature (891)..(891): n is a, c, g, or t
  misc_feature (893)..(893): n is a, c, g, or t
ggaagcagggagagagaactggccagggnataaaaagggcccacaagagaccggctctaggatcccaaggcccaactccccgaaccactcagggtcctgtggacagctcacctagtggcaatggctccaggctcccggacgtccctgctcctggcttttgccctgctctgcctgccctggcttcaagagggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733894 - DNA, 863 bp, Homo sapiens
  misc_feature (10)..(10): n is a, c, g, or t
  misc_feature (833)..(833): n is a, c, g, or t
  misc_feature (835)..(835): n is a, c, g, or t
  misc_feature (837)..(837): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733895 - DNA, 863 bp, Homo sapiens
  misc_feature (10)..(10): n is a, c, g, or t
  misc_feature (214)..(214): n is a, c, g, or t
  misc_feature (833)..(833): n is a, c, g, or t
  misc_feature (835)..(835): n is a, c, g, or t
  misc_feature (837)..(837): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagagggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733896 - DNA, 837 bp, Homo sapiens
  misc_feature (29)..(29): n is a, c, g, or t
  misc_feature (691)..(691): n is a, c, g, or t
  misc_feature (693)..(693): n is a, c, g, or t
  misc_feature (732)..(732): n is a, c, g, or t
  misc_feature (735)..(735): n is a, c, g, or t
  misc_feature (739)..(739): n is a, c, g, or t
  misc_feature (741)..(744): n is a, c, g, or t
  misc_feature (767)..(771): n is a, c, g, or t
  misc_feature (802)..(802): n is a, c, g, or t
ggaagcagggagagagaactggccagggnataaaaagggcccacaagagaccggctctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733897 - DNA, 827 bp, Homo sapiens
  misc_feature (44)..(44): n is a, c, g, or t
  misc_feature (51)..(51): n is a, c, g, or t
  misc_feature (797)..(797): n is a, c, g, or t
  misc_feature (799)..(799): n is a, c, g, or t
  misc_feature (801)..(801): n is a, c, g, or t
cacccaggcgcacttcttgccctccggtttctccccaggctccnggacgtncctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733898 - DNA, 745 bp, Homo sapiens
  misc_feature (44)..(44): n is a, c, g, or t
  misc_feature (51)..(51): n is a, c, g, or t
  misc_feature (599)..(599): n is a, c, g, or t
  misc_feature (601)..(601): n is a, c, g, or t
  misc_feature (640)..(640): n is a, c, g, or t
  misc_feature (643)..(643): n is a, c, g, or t
  misc_feature (647)..(647): n is a, c, g, or t
  misc_feature (649)..(652): n is a, c, g, or t
  misc_feature (675)..(679): n is a, c, g, or t
  misc_feature (710)..(710): n is a, c, g, or t
cacccaggcgcacttcttgccctccggtttctccccaggctccnggacgtncctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733899 - DNA, 781 bp, Homo sapiens
  misc_feature (10)..(10): n is a, c, g, or t
  misc_feature (635)..(635): n is a, c, g, or t
  misc_feature (637)..(637): n is a, c, g, or t
  misc_feature (676)..(676): n is a, c, g, or t
  misc_feature (679)..(679): n is a, c, g, or t
  misc_feature (683)..(683): n is a, c, g, or t
  misc_feature (685)..(688): n is a, c, g, or t
  misc_feature (711)..(715): n is a, c, g, or t
  misc_feature (746)..(746): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733900 - DNA, 866 bp, Homo sapiens
  misc_feature (10)..(10): n is a, c, g, or t
  misc_feature (244)..(244): n is a, c, g, or t
  misc_feature (836)..(836): n is a, c, g, or t
  misc_feature (838)..(838): n is a, c, g, or t
  misc_feature (840)..(840): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733901 - DNA, 784 bp, Homo sapiens
  misc_feature (10)..(10): n is a, c, g, or t
  misc_feature (244)..(244): n is a, c, g, or t
  misc_feature (638)..(638): n is a, c, g, or t
  misc_feature (640)..(640): n is a, c, g, or t
  misc_feature (679)..(679): n is a, c, g, or t
  misc_feature (682)..(682): n is a, c, g, or t
  misc_feature (686)..(686): n is a, c, g, or t
  misc_feature (688)..(691): n is a, c, g, or t
  misc_feature (714)..(718): n is a, c, g, or t
  misc_feature (749)..(749): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733902 - DNA, 863 bp, Homo sapiens
  misc_feature (10)..(10): n is a, c, g, or t
  misc_feature (228)..(228): n is a, c, g, or t
  misc_feature (240)..(240): n is a, c, g, or t
  misc_feature (833)..(833): n is a, c, g, or t
  misc_feature (835)..(835): n is a, c, g, or t
  misc_feature (837)..(837): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattcccccctcccnggcgtttgcagncccctctctccccccggccccgccgtcttcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733903 - DNA, 771 bp, Homo sapiens
  misc_feature (10)..(10): n is a, c, g, or t
  misc_feature (214)..(214): n is a, c, g, or t
  misc_feature (532)..(532): n is a, c, g, or t
  misc_feature (539)..(539): n is a, c, g, or t
  misc_feature (547)..(547): n is a, c, g, or t
  misc_feature (552)..(554): n is a, c, g, or t
  misc_feature (565)..(566): n is a, c, g, or t
  misc_feature (568)..(568): n is a, c, g, or t
  misc_feature (571)..(571): n is a, c, g, or t
  misc_feature (580)..(580): n is a, c, g, or t
  misc_feature (582)..(582): n is a, c, g, or t
  misc_feature (589)..(589): n is a, c, g, or t
  misc_feature (593)..(593): n is a, c, g, or t
  misc_feature (597)..(597): n is a, c, g, or t
  misc_feature (599)..(601): n is a, c, g, or t
  misc_feature (605)..(605): n is a, c, g, or t
  misc_feature (608)..(608): n is a, c, g, or t
  misc_feature (610)..(610): n is a, c, g, or t
  misc_feature (625)..(625): n is a, c, g, or t
  misc_feature (636)..(636): n is a, c, g, or t
  misc_feature (639)..(639): n is a, c, g, or t
  misc_feature (654)..(654): n is a, c, g, or t
  misc_feature (672)..(672): n is a, c, g, or t
  misc_feature (681)..(681): n is a, c, g, or t
  misc_feature (686)..(686): n is a, c, g, or t
  misc_feature (708)..(708): n is a, c, g, or t
  misc_feature (729)..(729): n is a, c, g, or t
  misc_feature (731)..(731): n is a, c, g, or t
  misc_feature (736)..(736): n is a, c, g, or t
  misc_feature (738)..(738): n is a, c, g, or t
  misc_feature (740)..(740): n is a, c, g, or t
  misc_feature (742)..(744): n is a, c, g, or t
  misc_feature (746)..(746): n is a, c, g, or t
  misc_feature (748)..(748): n is a, c, g, or t
  misc_feature (752)..(752): n is a, c, g, or t
  misc_feature (754)..(754): n is a, c, g, or t
  misc_feature (756)..(756): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagagggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcnccagggntccccaancctgnnnccccactggcnncnagngctggggananaaacacngctncccncnnnttancantnaggcgctgacccaanagaactcaccntantcttcatttcccctngtgaatcctccaggcctntctctacancctgnaggggagggaggaaaatggatnaatgagagagggagggaacantnccaancncntnnncncncccncncntccttcactttgcag

SEQ ID NO: 733904 - DNA, 781 bp, Homo sapiens
  misc_feature (10)..(10): n is a, c, g, or t
  misc_feature (214)..(214): n is a, c, g, or t
  misc_feature (635)..(635): n is a, c, g, or t
  misc_feature (637)..(637): n is a, c, g, or t
  misc_feature (676)..(676): n is a, c, g, or t
  misc_feature (679)..(679): n is a, c, g, or t
  misc_feature (683)..(683): n is a, c, g, or t
  misc_feature (685)..(688): n is a, c, g, or t
  misc_feature (711)..(715): n is a, c, g, or t
  misc_feature (746)..(746): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagagggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733905 - DNA, 495 bp, Homo sapiens
  misc_feature (465)..(465): n is a, c, g, or t
  misc_feature (467)..(467): n is a, c, g, or t
  misc_feature (469)..(469): n is a, c, g, or t
tcgagcggccgcccgggcaggtcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733906 - DNA, 413 bp, Homo sapiens
  misc_feature (267)..(267): n is a, c, g, or t
  misc_feature (269)..(269): n is a, c, g, or t
  misc_feature (308)..(308): n is a, c, g, or t
  misc_feature (311)..(311): n is a, c, g, or t
  misc_feature (315)..(315): n is a, c, g, or t
  misc_feature (317)..(320): n is a, c, g, or t
  misc_feature (343)..(347): n is a, c, g, or t
  misc_feature (378)..(378): n is a, c, g, or t
tcgagcggccgcccgggcaggtcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733907 - DNA, 720 bp, Homo sapiens
  misc_feature (19)..(19): n is a, c, g, or t
  misc_feature (574)..(574): n is a, c, g, or t
  misc_feature (576)..(576): n is a, c, g, or t
  misc_feature (615)..(615): n is a, c, g, or t
  misc_feature (618)..(618): n is a, c, g, or t
  misc_feature (622)..(622): n is a, c, g, or t
  misc_feature (624)..(627): n is a, c, g, or t
  misc_feature (650)..(654): n is a, c, g, or t
  misc_feature (685)..(685): n is a, c, g, or t
caggtctgtgcgtactagngatgtcagtccgacgtccttgtctggtttgcctgtctgctgcctggttcaagagctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733908 - DNA, 805 bp, Homo sapiens
  misc_feature (19)..(19): n is a, c, g, or t
  misc_feature (183)..(183): n is a, c, g, or t
  misc_feature (775)..(775): n is a, c, g, or t
  misc_feature (777)..(777): n is a, c, g, or t
  misc_feature (779)..(779): n is a, c, g, or t
caggtctgtgcgtactagngatgtcagtccgacgtccttgtctggtttgcctgtctgctgcctggttcaagagctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733909 - DNA, 723 bp, Homo sapiens
  misc_feature (19)..(19): n is a, c, g, or t
  misc_feature (183)..(183): n is a, c, g, or t
  misc_feature (577)..(577): n is a, c, g, or t
  misc_feature (579)..(579): n is a, c, g, or t
  misc_feature (618)..(618): n is a, c, g, or t
  misc_feature (621)..(621): n is a, c, g, or t
  misc_feature (625)..(625): n is a, c, g, or t
  misc_feature (627)..(630): n is a, c, g, or t
  misc_feature (653)..(657): n is a, c, g, or t
  misc_feature (688)..(688): n is a, c, g, or t
caggtctgtgcgtactagngatgtcagtccgacgtccttgtctggtttgcctgtctgctgcctggttcaagagctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733910 - DNA, 881 bp, Homo sapiens
  misc_feature (29)..(29): n is a, c, g, or t
  misc_feature (875)..(876): n is a, c, g, or t
ggaagcagggagagagaactggccagggnataaaaagggcccacaagagaccggctctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733911 - DNA, 836 bp, Homo sapiens
  misc_feature (29)..(29): n is a, c, g, or t
  misc_feature (778)..(778): n is a, c, g, or t
  misc_feature (813)..(813): n is a, c, g, or t
ggaagcagggagagagaactggccagggnataaaaagggcccacaagagaccggctctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733912 - DNA, 751 bp, Homo sapiens
  misc_feature (29)..(29): n is a, c, g, or t
  misc_feature (668)..(668): n is a, c, g, or t
  misc_feature (672)..(672): n is a, c, g, or t
  misc_feature (720)..(720): n is a, c, g, or t
  misc_feature (722)..(722): n is a, c, g, or t
  misc_feature (735)..(735): n is a, c, g, or t
  misc_feature (739)..(741): n is a, c, g, or t
  misc_feature (743)..(743): n is a, c, g, or t
ggaagcagggagagagaactggccagggnataaaaagggcccacaagagaccggctctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatngcgngcaccagctggccattgacacctaccaggagtttgaagaaacctatancncaaaggaccaggnactnnngnccagcgta

SEQ ID NO: 733913 - DNA, 1110 bp, Homo sapiens
  misc_feature (29)..(29): n is a, c, g, or t
ggaagcagggagagagaactggccagggnataaaaagggcccacaagagaccggctctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaatagcttcgccgacaagcacttgacgtcactgctcaaagaagcttgacggggcttgctcatacatgactttcacggcaaatggtactatggcacaaagggtcgaggaacaattctctgggcggcattgtgctgccaggtggtcccgtcttcttgtgagatggtggcagccctggttgggtctttctgaagagtgccccagagtaggcatacctgtggactcccttcctctcaggtgccctctcgctgggggcccatggaaaagggtggggcactatcccaggtgtggccccgaacccgaagtccattggtttccctaaattaacatcactttaaaggttgggttattcttattcgcaaataataacccatgtaattaatggaatcaattaccagaatataagaacaatatttcgcgaggcctctcaattgtgggccgtatgaaaaagaatgttatgtaataaccgcag

SEQ ID NO: 733914 - DNA, 1132 bp, Homo sapiens
  misc_feature (29)..(29): n is a, c, g, or t
  misc_feature (588)..(588): n is a, c, g, or t
  misc_feature (595)..(595): n is a, c, g, or t
  misc_feature (603)..(603): n is a, c, g, or t
  misc_feature (608)..(610): n is a, c, g, or t
  misc_feature (621)..(622): n is a, c, g, or t
  misc_feature (624)..(624): n is a, c, g, or t
  misc_feature (627)..(627): n is a, c, g, or t
  misc_feature (636)..(636): n is a, c, g, or t
  misc_feature (638)..(638): n is a, c, g, or t
  misc_feature (645)..(645): n is a, c, g, or t
  misc_feature (649)..(649): n is a, c, g, or t
  misc_feature (653)..(653): n is a, c, g, or t
  misc_feature (655)..(657): n is a, c, g, or t
  misc_feature (661)..(661): n is a, c, g, or t
  misc_feature (664)..(664): n is a, c, g, or t
  misc_feature (666)..(666): n is a, c, g, or t
  misc_feature (681)..(681): n is a, c, g, or t
  misc_feature (692)..(692): n is a, c, g, or t
  misc_feature (695)..(695): n is a, c, g, or t
  misc_feature (710)..(710): n is a, c, g, or t
  misc_feature (728)..(728): n is a, c, g, or t
  misc_feature (737)..(737): n is a, c, g, or t
  misc_feature (742)..(742): n is a, c, g, or t
  misc_feature (764)..(764): n is a, c, g, or t
  misc_feature (785)..(785): n is a, c, g, or t
  misc_feature (787)..(787): n is a, c, g, or t
  misc_feature (792)..(792): n is a, c, g, or t
  misc_feature (794)..(794): n is a, c, g, or t
  misc_feature (796)..(796): n is a, c, g, or t
  misc_feature (798)..(800): n is a, c, g, or t
  misc_feature (802)..(802): n is a, c, g, or t
  misc_feature (804)..(804): n is a, c, g, or t
  misc_feature (808)..(808): n is a, c, g, or t
  misc_feature (810)..(810): n is a, c, g, or t
  misc_feature (812)..(812): n is a, c, g, or t
  misc_feature (1126)..(1127): n is a, c, g, or t
ggaagcagggagagagaactggccagggnataaaaagggcccacaagagaccggctctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcnccagggntccccaancctgnnnccccactggcnncnagngctggggananaaacacngctncccncnnnttancantnaggcgctgacccaanagaactcaccntantcttcatttcccctngtgaatcctccaggcctntctctacancctgnaggggagggaggaaaatggatnaatgagagagggagggaacantnccaancncntnnncncncccncncntccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733915 - DNA, 1170 bp, Homo sapiens
  misc_feature (29)..(29): n is a, c, g, or t
  misc_feature (588)..(588): n is a, c, g, or t
  misc_feature (595)..(595): n is a, c, g, or t
  misc_feature (603)..(603): n is a, c, g, or t
  misc_feature (608)..(610): n is a, c, g, or t
  misc_feature (621)..(622): n is a, c, g, or t
  misc_feature (624)..(624): n is a, c, g, or t
  misc_feature (627)..(627): n is a, c, g, or t
  misc_feature (636)..(636): n is a, c, g, or t
  misc_feature (638)..(638): n is a, c, g, or t
  misc_feature (645)..(645): n is a, c, g, or t
  misc_feature (649)..(649): n is a, c, g, or t
  misc_feature (653)..(653): n is a, c, g, or t
  misc_feature (655)..(657): n is a, c, g, or t
  misc_feature (661)..(661): n is a, c, g, or t
  misc_feature (664)..(664): n is a, c, g, or t
  misc_feature (666)..(666): n is a, c, g, or t
  misc_feature (681)..(681): n is a, c, g, or t
  misc_feature (692)..(692): n is a, c, g, or t
  misc_feature (695)..(695): n is a, c, g, or t
  misc_feature (710)..(710): n is a, c, g, or t
  misc_feature (728)..(728): n is a, c, g, or t
  misc_feature (737)..(737): n is a, c, g, or t
  misc_feature (742)..(742): n is a, c, g, or t
  misc_feature (764)..(764): n is a, c, g, or t
  misc_feature (785)..(785): n is a, c, g, or t
  misc_feature (787)..(787): n is a, c, g, or t
  misc_feature (792)..(792): n is a, c, g, or t
  misc_feature (794)..(794): n is a, c, g, or t
  misc_feature (796)..(796): n is a, c, g, or t
  misc_feature (798)..(800): n is a, c, g, or t
  misc_feature (802)..(802): n is a, c, g, or t
  misc_feature (804)..(804): n is a, c, g, or t
  misc_feature (808)..(808): n is a, c, g, or t
  misc_feature (810)..(810): n is a, c, g, or t
  misc_feature (812)..(812): n is a, c, g, or t
  misc_feature (1140)..(1140): n is a, c, g, or t
  misc_feature (1142)..(1142): n is a, c, g, or t
  misc_feature (1144)..(1144): n is a, c, g, or t
ggaagcagggagagagaactggccagggnataaaaagggcccacaagagaccggctctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcnccagggntccccaancctgnnnccccactggcnncnagngctggggananaaacacngctncccncnnnttancantnaggcgctgacccaanagaactcaccntantcttcatttcccctngtgaatcctccaggcctntctctacancctgnaggggagggaggaaaatggatnaatgagagagggagggaacantnccaancncntnnncncncccncncntccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733916 - DNA, 726 bp, Homo sapiens
  misc_feature (169)..(169): n is a, c, g, or t
  misc_feature (487)..(487): n is a, c, g, or t
  misc_feature (494)..(494): n is a, c, g, or t
  misc_feature (502)..(502): n is a, c, g, or t
  misc_feature (507)..(509): n is a, c, g, or t
  misc_feature (520)..(521): n is a, c, g, or t
  misc_feature (523)..(523): n is a, c, g, or t
  misc_feature (526)..(526): n is a, c, g, or t
  misc_feature (535)..(535): n is a, c, g, or t
  misc_feature (537)..(537): n is a, c, g, or t
  misc_feature (544)..(544): n is a, c, g, or t
  misc_feature (548)..(548): n is a, c, g, or t
  misc_feature (552)..(552): n is a, c, g, or t
  misc_feature (554)..(556): n is a, c, g, or t
  misc_feature (560)..(560): n is a, c, g, or t
  misc_feature (563)..(563): n is a, c, g, or t
  misc_feature (565)..(565): n is a, c, g, or t
  misc_feature (580)..(580): n is a, c, g, or t
  misc_feature (591)..(591): n is a, c, g, or t
  misc_feature (594)..(594): n is a, c, g, or t
  misc_feature (609)..(609): n is a, c, g, or t
  misc_feature (627)..(627): n is a, c, g, or t
  misc_feature (636)..(636): n is a, c, g, or t
  misc_feature (641)..(641): n is a, c, g, or t
  misc_feature (663)..(663): n is a, c, g, or t
  misc_feature (684)..(684): n is a, c, g, or t
  misc_feature (686)..(686): n is a, c, g, or t
  misc_feature (691)..(691): n is a, c, g, or t
  misc_feature (693)..(693): n is a, c, g, or t
  misc_feature (695)..(695): n is a, c, g, or t
  misc_feature (697)..(699): n is a, c, g, or t
  misc_feature (701)..(701): n is a, c, g, or t
  misc_feature (703)..(703): n is a, c, g, or t
  misc_feature (707)..(707): n is a, c, g, or t
  misc_feature (709)..(709): n is a, c, g, or t
  misc_feature (711)..(711): n is a, c, g, or t
cgatctagaggaccccgcgtacagttgcgggacgtccctgctctggtttttgcctgttctgcttgcctggtttcaagaggctggtgcgggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcnccagggntccccaancctgnnnccccactggcnncnagngctggggananaaacacngctncccncnnnttancantnaggcgctgacccaanagaactcaccntantcttcatttcccctngtgaatcctccaggcctntctctacancctgnaggggagggaggaaaatggatnaatgagagagggagggaacantnccaancncntnnncncncccncncntccttcactttgcag

SEQ ID NO: 733917 - DNA, 650 bp, Homo sapiens
  misc_feature (169)..(169): n is a, c, g, or t
  misc_feature (567)..(567): n is a, c, g, or t
  misc_feature (571)..(571): n is a, c, g, or t
  misc_feature (619)..(619): n is a, c, g, or t
  misc_feature (621)..(621): n is a, c, g, or t
  misc_feature (634)..(634): n is a, c, g, or t
  misc_feature (638)..(640): n is a, c, g, or t
  misc_feature (642)..(642): n is a, c, g, or t
cgatctagaggaccccgcgtacagttgcgggacgtccctgctctggtttttgcctgttctgcttgcctggtttcaagaggctggtgcgggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatngcgngcaccagctggccattgacacctaccaggagtttgaagaaacctatancncaaaggaccaggnactnnngnccagcgta

SEQ ID NO: 733918 - DNA, 818 bp, Homo sapiens
  misc_feature (169)..(169): n is a, c, g, or t
  misc_feature (788)..(788): n is a, c, g, or t
  misc_feature (790)..(790): n is a, c, g, or t
  misc_feature (792)..(792): n is a, c, g, or t
cgatctagaggaccccgcgtacagttgcgggacgtccctgctctggtttttgcctgttctgcttgcctggtttcaagaggctggtgcgggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733919 - DNA, 780 bp, Homo sapiens
  misc_feature (169)..(169): n is a, c, g, or t
  misc_feature (774)..(775): n is a, c, g, or t
cgatctagaggaccccgcgtacagttgcgggacgtccctgctctggtttttgcctgttctgcttgcctggtttcaagaggctggtgcgggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733920 - DNA, 735 bp, Homo sapiens
  misc_feature (169)..(169): n is a, c, g, or t
  misc_feature (677)..(677): n is a, c, g, or t
  misc_feature (712)..(712): n is a, c, g, or t
cgatctagaggaccccgcgtacagttgcgggacgtccctgctctggtttttgcctgttctgcttgcctggtttcaagaggctggtgcgggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733921 - DNA, 736 bp, Homo sapiens
  misc_feature (169)..(169): n is a, c, g, or t
  misc_feature (590)..(590): n is a, c, g, or t
  misc_feature (592)..(592): n is a, c, g, or t
  misc_feature (631)..(631): n is a, c, g, or t
  misc_feature (634)..(634): n is a, c, g, or t
  misc_feature (638)..(638): n is a, c, g, or t
  misc_feature (640)..(643): n is a, c, g, or t
  misc_feature (666)..(670): n is a, c, g, or t
  misc_feature (701)..(701): n is a, c, g, or t
cgatctagaggaccccgcgtacagttgcgggacgtccctgctctggtttttgcctgttctgcttgcctggtttcaagaggctggtgcgggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733922 - DNA, 1009 bp, Homo sapiens
  misc_feature (169)..(169): n is a, c, g, or t
cgatctagaggaccccgcgtacagttgcgggacgtccctgctctggtttttgcctgttctgcttgcctggtttcaagaggctggtgcgggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaatagcttcgccgacaagcacttgacgtcactgctcaaagaagcttgacggggcttgctcatacatgactttcacggcaaatggtactatggcacaaagggtcgaggaacaattctctgggcggcattgtgctgccaggtggtcccgtcttcttgtgagatggtggcagccctggttgggtctttctgaagagtgccccagagtaggcatacctgtggactcccttcctctcaggtgccctctcgctgggggcccatggaaaagggtggggcactatcccaggtgtggccccgaacccgaagtccattggtttccctaaattaacatcactttaaaggttgggttattcttattcgcaaataataacccatgtaattaatggaatcaattaccagaatataagaacaatatttcgcgaggcctctcaattgtgggccgtatgaaaaagaatgttatgtaataaccgcag

SEQ ID NO: 733923 - DNA, 790 bp, Homo sapiens
  misc_feature (760)..(760): n is a, c, g, or t
  misc_feature (762)..(762): n is a, c, g, or t
  misc_feature (764)..(764): n is a, c, g, or t
ggaggtgacgtctagatgatccccgttcgcgccttttctggtattaaatcagagcaggctgccgtgcagtccgttcctgttagtccagagctaatgactcatcgctcattctgccaatctcattgcgcgcaccacctggctatttatacctacccagattttgcgcacgatgatcttgcagcataccgtaattattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733924 - DNA, 752 bp, Homo sapiens
  misc_feature (746)..(747): n is a, c, g, or t
ggaggtgacgtctagatgatccccgttcgcgccttttctggtattaaatcagagcaggctgccgtgcagtccgttcctgttagtccagagctaatgactcatcgctcattctgccaatctcattgcgcgcaccacctggctatttatacctacccagattttgcgcacgatgatcttgcagcataccgtaattattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733925 - DNA, 707 bp, Homo sapiens
  misc_feature (649)..(649): n is a, c, g, or t
  misc_feature (684)..(684): n is a, c, g, or t
ggaggtgacgtctagatgatccccgttcgcgccttttctggtattaaatcagagcaggctgccgtgcagtccgttcctgttagtccagagctaatgactcatcgctcattctgccaatctcattgcgcgcaccacctggctatttatacctacccagattttgcgcacgatgatcttgcagcataccgtaattattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733926 - DNA, 652 bp, Homo sapiens
  misc_feature (622)..(622): n is a, c, g, or t
  misc_feature (624)..(624): n is a, c, g, or t
  misc_feature (626)..(626): n is a, c, g, or t
gtcacgcctatcatgcaggtttgtagacacctctgtccctttggacactataagtgttcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733927 - DNA, 614 bp, Homo sapiens
  misc_feature (608)..(609): n is a, c, g, or t
gtcacgcctatcatgcaggtttgtagacacctctgtccctttggacactataagtgttcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733928 - DNA, 569 bp, Homo sapiens
  misc_feature (511)..(511): n is a, c, g, or t
  misc_feature (546)..(546): n is a, c, g, or t
gtcacgcctatcatgcaggtttgtagacacctctgtccctttggacactataagtgttcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733929 - DNA, 570 bp, Homo sapiens
  misc_feature (424)..(424): n is a, c, g, or t
  misc_feature (426)..(426): n is a, c, g, or t
  misc_feature (465)..(465): n is a, c, g, or t
  misc_feature (468)..(468): n is a, c, g, or t
  misc_feature (472)..(472): n is a, c, g, or t
  misc_feature (474)..(477): n is a, c, g, or t
  misc_feature (500)..(504): n is a, c, g, or t
  misc_feature (535)..(535): n is a, c, g, or t
gtcacgcctatcatgcaggtttgtagacacctctgtccctttggacactataagtgttcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733930 - DNA, 388 bp, Homo sapiens
  misc_feature (382)..(383): n is a, c, g, or t
cagagtggcgggagcccgtgcgctaccgaacacctcggacagcgatgacacccagagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733931 - DNA, 426 bp, Homo sapiens
  misc_feature (396)..(396): n is a, c, g, or t
  misc_feature (398)..(398): n is a, c, g, or t
  misc_feature (400)..(400): n is a, c, g, or t
cagagtggcgggagcccgtgcgctaccgaacacctcggacagcgatgacacccagagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733932 - DNA, 343 bp, Homo sapiens
  misc_feature (285)..(285): n is a, c, g, or t
  misc_feature (320)..(320): n is a, c, g, or t
cagagtggcgggagcccgtgcgctaccgaacacctcggacagcgatgacacccagagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733933 - DNA, 683 bp, Homo sapiens
  misc_feature (677)..(678): n is a, c, g, or t
ggcaatacagcaagatcccatctctattttaaagaaaagtctcactttgggaggccaaggcgggtggatcacaaggtcaggagatcgagaccatcctggccaacatagtaaaaccccatctccactaaaaatacaaaaaagtagctgggactacaggcgcccgcctacacgcccggctaattttttgtatttttttttagtagagatggggtttcactgtgttagccaggatggcctcaatctcctgacctcgtgatccgcccgtctcggcctcccaaagtgctgggattacaggcgtgagccaccgcgcccggcccaagaattctttctggaaacaaagaaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733934 - DNA, 721 bp, Homo sapiens
  misc_feature (691)..(691): n is a, c, g, or t
  misc_feature (693)..(693): n is a, c, g, or t
  misc_feature (695)..(695): n is a, c, g, or t
ggcaatacagcaagatcccatctctattttaaagaaaagtctcactttgggaggccaaggcgggtggatcacaaggtcaggagatcgagaccatcctggccaacatagtaaaaccccatctccactaaaaatacaaaaaagtagctgggactacaggcgcccgcctacacgcccggctaattttttgtatttttttttagtagagatggggtttcactgtgttagccaggatggcctcaatctcctgacctcgtgatccgcccgtctcggcctcccaaagtgctgggattacaggcgtgagccaccgcgcccggcccaagaattctttctggaaacaaagaaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733935 - DNA, 638 bp, Homo sapiens
  misc_feature (580)..(580): n is a, c, g, or t
  misc_feature (615)..(615): n is a, c, g, or t
ggcaatacagcaagatcccatctctattttaaagaaaagtctcactttgggaggccaaggcgggtggatcacaaggtcaggagatcgagaccatcctggccaacatagtaaaaccccatctccactaaaaatacaaaaaagtagctgggactacaggcgcccgcctacacgcccggctaattttttgtatttttttttagtagagatggggtttcactgtgttagccaggatggcctcaatctcctgacctcgtgatccgcccgtctcggcctcccaaagtgctgggattacaggcgtgagccaccgcgcccggcccaagaattctttctggaaacaaagaaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733936 - DNA, 789 bp, Homo sapiens
  misc_feature (44)..(44): n is a, c, g, or t
  misc_feature (51)..(51): n is a, c, g, or t
  misc_feature (783)..(784): n is a, c, g, or t
cacccaggcgcacttcttgccctccggtttctccccaggctccnggacgtncctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733937 - DNA, 744 bp, Homo sapiens
  misc_feature (44)..(44): n is a, c, g, or t
  misc_feature (51)..(51): n is a, c, g, or t
  misc_feature (686)..(686): n is a, c, g, or t
  misc_feature (721)..(721): n is a, c, g, or t
cacccaggcgcacttcttgccctccggtttctccccaggctccnggacgtncctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733938 - DNA, 1018 bp, Homo sapiens
  misc_feature (44)..(44): n is a, c, g, or t
  misc_feature (51)..(51): n is a, c, g, or t
cacccaggcgcacttcttgccctccggtttctccccaggctccnggacgtncctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaatagcttcgccgacaagcacttgacgtcactgctcaaagaagcttgacggggcttgctcatacatgactttcacggcaaatggtactatggcacaaagggtcgaggaacaattctctgggcggcattgtgctgccaggtggtcccgtcttcttgtgagatggtggcagccctggttgggtctttctgaagagtgccccagagtaggcatacctgtggactcccttcctctcaggtgccctctcgctgggggcccatggaaaagggtggggcactatcccaggtgtggccccgaacccgaagtccattggtttccctaaattaacatcactttaaaggttgggttattcttattcgcaaataataacccatgtaattaatggaatcaattaccagaatataagaacaatatttcgcgaggcctctcaattgtgggccgtatgaaaaagaatgttatgtaataaccgcag

SEQ ID NO: 733939 - DNA, 659 bp, Homo sapiens
  misc_feature (44)..(44): n is a, c, g, or t
  misc_feature (51)..(51): n is a, c, g, or t
  misc_feature (576)..(576): n is a, c, g, or t
  misc_feature (580)..(580): n is a, c, g, or t
  misc_feature (628)..(628): n is a, c, g, or t
  misc_feature (630)..(630): n is a, c, g, or t
  misc_feature (643)..(643): n is a, c, g, or t
  misc_feature (647)..(649): n is a, c, g, or t
  misc_feature (651)..(651): n is a, c, g, or t
cacccaggcgcacttcttgccctccggtttctccccaggctccnggacgtncctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatngcgngcaccagctggccattgacacctaccaggagtttgaagaaacctatancncaaaggaccaggnactnnngnccagcgta

SEQ ID NO: 733940 - DNA, 1040 bp, Homo sapiens
  misc_feature (44)..(44): n is a, c, g, or t
  misc_feature (51)..(51): n is a, c, g, or t
  misc_feature (496)..(496): n is a, c, g, or t
  misc_feature (503)..(503): n is a, c, g, or t
  misc_feature (511)..(511): n is a, c, g, or t
  misc_feature (516)..(518): n is a, c, g, or t
  misc_feature (529)..(530): n is a, c, g, or t
  misc_feature (532)..(532): n is a, c, g, or t
  misc_feature (535)..(535): n is a, c, g, or t
  misc_feature (544)..(544): n is a, c, g, or t
  misc_feature (546)..(546): n is a, c, g, or t
  misc_feature (553)..(553): n is a, c, g, or t
  misc_feature (557)..(557): n is a, c, g, or t
  misc_feature (561)..(561): n is a, c, g, or t
  misc_feature (563)..(565): n is a, c, g, or t
  misc_feature (569)..(569): n is a, c, g, or t
  misc_feature (572)..(572): n is a, c, g, or t
  misc_feature (574)..(574): n is a, c, g, or t
  misc_feature (589)..(589): n is a, c, g, or t
  misc_feature (600)..(600): n is a, c, g, or t
  misc_feature (603)..(603): n is a, c, g, or t
  misc_feature (618)..(618): n is a, c, g, or t
  misc_feature (636)..(636): n is a, c, g, or t
  misc_feature (645)..(645): n is a, c, g, or t
  misc_feature (650)..(650): n is a, c, g, or t
  misc_feature (672)..(672): n is a, c, g, or t
  misc_feature (693)..(693): n is a, c, g, or t
  misc_feature (695)..(695): n is a, c, g, or t
  misc_feature (700)..(700): n is a, c, g, or t
  misc_feature (702)..(702): n is a, c, g, or t
  misc_feature (704)..(704): n is a, c, g, or t
  misc_feature (706)..(708): n is a, c, g, or t
  misc_feature (710)..(710): n is a, c, g, or t
  misc_feature (712)..(712): n is a, c, g, or t
  misc_feature (716)..(716): n is a, c, g, or t
  misc_feature (718)..(718): n is a, c, g, or t
  misc_feature (720)..(720): n is a, c, g, or t
  misc_feature (1034)..(1035): n is a, c, g, or t
cacccaggcgcacttcttgccctccggtttctccccaggctccnggacgtncctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcnccagggntccccaancctgnnnccccactggcnncnagngctggggananaaacacngctncccncnnnttancantnaggcgctgacccaanagaactcaccntantcttcatttcccctngtgaatcctccaggcctntctctacancctgnaggggagggaggaaaatggatnaatgagagagggagggaacantnccaancncntnnncncncccncncntccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733941 - DNA, 1078 bp, Homo sapiens
  misc_feature (44)..(44): n is a, c, g, or t
  misc_feature (51)..(51): n is a, c, g, or t
  misc_feature (496)..(496): n is a, c, g, or t
  misc_feature (503)..(503): n is a, c, g, or t
  misc_feature (511)..(511): n is a, c, g, or t
  misc_feature (516)..(518): n is a, c, g, or t
  misc_feature (529)..(530): n is a, c, g, or t
  misc_feature (532)..(532): n is a, c, g, or t
  misc_feature (535)..(535): n is a, c, g, or t
  misc_feature (544)..(544): n is a, c, g, or t
  misc_feature (546)..(546): n is a, c, g, or t
  misc_feature (553)..(553): n is a, c, g, or t
  misc_feature (557)..(557): n is a, c, g, or t
  misc_feature (561)..(561): n is a, c, g, or t
  misc_feature (563)..(565): n is a, c, g, or t
  misc_feature (569)..(569): n is a, c, g, or t
  misc_feature (572)..(572): n is a, c, g, or t
  misc_feature (574)..(574): n is a, c, g, or t
  misc_feature (589)..(589): n is a, c, g, or t
  misc_feature (600)..(600): n is a, c, g, or t
  misc_feature (603)..(603): n is a, c, g, or t
  misc_feature (618)..(618): n is a, c, g, or t
  misc_feature (636)..(636): n is a, c, g, or t
  misc_feature (645)..(645): n is a, c, g, or t
  misc_feature (650)..(650): n is a, c, g, or t
  misc_feature (672)..(672): n is a, c, g, or t
  misc_feature (693)..(693): n is a, c, g, or t
  misc_feature (695)..(695): n is a, c, g, or t
  misc_feature (700)..(700): n is a, c, g, or t
  misc_feature (702)..(702): n is a, c, g, or t
  misc_feature (704)..(704): n is a, c, g, or t
  misc_feature (706)..(708): n is a, c, g, or t
  misc_feature (710)..(710): n is a, c, g, or t
  misc_feature (712)..(712): n is a, c, g, or t
  misc_feature (716)..(716): n is a, c, g, or t
  misc_feature (718)..(718): n is a, c, g, or t
  misc_feature (720)..(720): n is a, c, g, or t
  misc_feature (1048)..(1048): n is a, c, g, or t
  misc_feature (1050)..(1050): n is a, c, g, or t
  misc_feature (1052)..(1052): n is a, c, g, or t
cacccaggcgcacttcttgccctccggtttctccccaggctccnggacgtncctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcnccagggntccccaancctgnnnccccactggcnncnagngctggggananaaacacngctncccncnnnttancantnaggcgctgacccaanagaactcaccntantcttcatttcccctngtgaatcctccaggcctntctctacancctgnaggggagggaggaaaatggatnaatgagagagggagggaacantnccaancncntnnncncncccncncntccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733942 - DNA, 832 bp, Homo sapiens
  misc_feature (802)..(802): n is a, c, g, or t
  misc_feature (804)..(804): n is a, c, g, or t
  misc_feature (806)..(806): n is a, c, g, or t
cgtgtgctgggtgatctagaggcatccggtaggcctgaagcctgcagtccggcagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733943 - DNA, 794 bp, Homo sapiens
  misc_feature (788)..(789): n is a, c, g, or t
cgtgtgctgggtgatctagaggcatccggtaggcctgaagcctgcagtccggcagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733944 - DNA, 749 bp, Homo sapiens
  misc_feature (691)..(691): n is a, c, g, or t
  misc_feature (726)..(726): n is a, c, g, or t
cgtgtgctgggtgatctagaggcatccggtaggcctgaagcctgcagtccggcagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733945 - DNA, 750 bp, Homo sapiens
  misc_feature (604)..(604): n is a, c, g, or t
  misc_feature (606)..(606): n is a, c, g, or t
  misc_feature (645)..(645): n is a, c, g, or t
  misc_feature (648)..(648): n is a, c, g, or t
  misc_feature (652)..(652): n is a, c, g, or t
  misc_feature (654)..(657): n is a, c, g, or t
  misc_feature (680)..(684): n is a, c, g, or t
  misc_feature (715)..(715): n is a, c, g, or t
cgtgtgctgggtgatctagaggcatccggtaggcctgaagcctgcagtccggcagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733946 - DNA, 1023 bp, Homo sapiens
cgtgtgctgggtgatctagaggcatccggtaggcctgaagcctgcagtccggcagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaatagcttcgccgacaagcacttgacgtcactgctcaaagaagcttgacggggcttgctcatacatgactttcacggcaaatggtactatggcacaaagggtcgaggaacaattctctgggcggcattgtgctgccaggtggtcccgtcttcttgtgagatggtggcagccctggttgggtctttctgaagagtgccccagagtaggcatacctgtggactcccttcctctcaggtgccctctcgctgggggcccatggaaaagggtggggcactatcccaggtgtggccccgaacccgaagtccattggtttccctaaattaacatcactttaaaggttgggttattcttattcgcaaataataacccatgtaattaatggaatcaattaccagaatataagaacaatatttcgcgaggcctctcaattgtgggccgtatgaaaaagaatgttatgtaataaccgcag

SEQ ID NO: 733947 - DNA, 664 bp, Homo sapiens
  misc_feature (581)..(581): n is a, c, g, or t
  misc_feature (585)..(585): n is a, c, g, or t
  misc_feature (633)..(633): n is a, c, g, or t
  misc_feature (635)..(635): n is a, c, g, or t
  misc_feature (648)..(648): n is a, c, g, or t
  misc_feature (652)..(654): n is a, c, g, or t
  misc_feature (656)..(656): n is a, c, g, or t
cgtgtgctgggtgatctagaggcatccggtaggcctgaagcctgcagtccggcagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatngcgngcaccagctggccattgacacctaccaggagtttgaagaaacctatancncaaaggaccaggnactnnngnccagcgta

SEQ ID NO: 733948 - DNA, 1045 bp, Homo sapiens
  misc_feature (501)..(501): n is a, c, g, or t
  misc_feature (508)..(508): n is a, c, g, or t
  misc_feature (516)..(516): n is a, c, g, or t
  misc_feature (521)..(523): n is a, c, g, or t
  misc_feature (534)..(535): n is a, c, g, or t
  misc_feature (537)..(537): n is a, c, g, or t
  misc_feature (540)..(540): n is a, c, g, or t
  misc_feature (549)..(549): n is a, c, g, or t
  misc_feature (551)..(551): n is a, c, g, or t
  misc_feature (558)..(558): n is a, c, g, or t
  misc_feature (562)..(562): n is a, c, g, or t
  misc_feature (566)..(566): n is a, c, g, or t
  misc_feature (568)..(570): n is a, c, g, or t
  misc_feature (574)..(574): n is a, c, g, or t
  misc_feature (577)..(577): n is a, c, g, or t
  misc_feature (579)..(579): n is a, c, g, or t
  misc_feature (594)..(594): n is a, c, g, or t
  misc_feature (605)..(605): n is a, c, g, or t
  misc_feature (608)..(608): n is a, c, g, or t
  misc_feature (623)..(623): n is a, c, g, or t
  misc_feature (641)..(641): n is a, c, g, or t
  misc_feature (650)..(650): n is a, c, g, or t
  misc_feature (655)..(655): n is a, c, g, or t
  misc_feature (677)..(677): n is a, c, g, or t
  misc_feature (698)..(698): n is a, c, g, or t
  misc_feature (700)..(700): n is a, c, g, or t
  misc_feature (705)..(705): n is a, c, g, or t
  misc_feature (707)..(707): n is a, c, g, or t
  misc_feature (709)..(709): n is a, c, g, or t
  misc_feature (711)..(713): n is a, c, g, or t
  misc_feature (715)..(715): n is a, c, g, or t
  misc_feature (717)..(717): n is a, c, g, or t
  misc_feature (721)..(721): n is a, c, g, or t
  misc_feature (723)..(723): n is a, c, g, or t
  misc_feature (725)..(725): n is a, c, g, or t
  misc_feature (1039)..(1040): n is a, c, g, or t
cgtgtgctgggtgatctagaggcatccggtaggcctgaagcctgcagtccggcagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcnccagggntccccaancctgnnnccccactggcnncnagngctggggananaaacacngctncccncnnnttancantnaggcgctgacccaanagaactcaccntantcttcatttcccctngtgaatcctccaggcctntctctacancctgnaggggagggaggaaaatggatnaatgagagagggagggaacantnccaancncntnnncncncccncncntccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733949 - DNA, 1083 bp, Homo sapiens
  misc_feature (501)..(501): n is a, c, g, or t
  misc_feature (508)..(508): n is a, c, g, or t
  misc_feature (516)..(516): n is a, c, g, or t
  misc_feature (521)..(523): n is a, c, g, or t
  misc_feature (534)..(535): n is a, c, g, or t
  misc_feature (537)..(537): n is a, c, g, or t
  misc_feature (540)..(540): n is a, c, g, or t
  misc_feature (549)..(549): n is a, c, g, or t
  misc_feature (551)..(551): n is a, c, g, or t
  misc_feature (558)..(558): n is a, c, g, or t
  misc_feature (562)..(562): n is a, c, g, or t
  misc_feature (566)..(566): n is a, c, g, or t
  misc_feature (568)..(570): n is a, c, g, or t
  misc_feature (574)..(574): n is a, c, g, or t
  misc_feature (577)..(577): n is a, c, g, or t
  misc_feature (579)..(579): n is a, c, g, or t
  misc_feature (594)..(594): n is a, c, g, or t
  misc_feature (605)..(605): n is a, c, g, or t
  misc_feature (608)..(608): n is a, c, g, or t
  misc_feature (623)..(623): n is a, c, g, or t
  misc_feature (641)..(641): n is a, c, g, or t
  misc_feature (650)..(650): n is a, c, g, or t
  misc_feature (655)..(655): n is a, c, g, or t
  misc_feature (677)..(677): n is a, c, g, or t
  misc_feature (698)..(698): n is a, c, g, or t
  misc_feature (700)..(700): n is a, c, g, or t
  misc_feature (705)..(705): n is a, c, g, or t
  misc_feature (707)..(707): n is a, c, g, or t
  misc_feature (709)..(709): n is a, c, g, or t
  misc_feature (711)..(713): n is a, c, g, or t
  misc_feature (715)..(715): n is a, c, g, or t
  misc_feature (717)..(717): n is a, c, g, or t
  misc_feature (721)..(721): n is a, c, g, or t
  misc_feature (723)..(723): n is a, c, g, or t
  misc_feature (725)..(725): n is a, c, g, or t
  misc_feature (1053)..(1053): n is a, c, g, or t
  misc_feature (1055)..(1055): n is a, c, g, or t
  misc_feature (1057)..(1057): n is a, c, g, or t
cgtgtgctgggtgatctagaggcatccggtaggcctgaagcctgcagtccggcagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcnccagggntccccaancctgnnnccccactggcnncnagngctggggananaaacacngctncccncnnnttancantnaggcgctgacccaanagaactcaccntantcttcatttcccctngtgaatcctccaggcctntctctacancctgnaggggagggaggaaaatggatnaatgagagagggagggaacantnccaancncntnnncncncccncncntccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733950 - DNA, 667 bp, Homo sapiens
  misc_feature (213)..(213): n is a, c, g, or t
  misc_feature (584)..(584): n is a, c, g, or t
  misc_feature (588)..(588): n is a, c, g, or t
  misc_feature (636)..(636): n is a, c, g, or t
  misc_feature (638)..(638): n is a, c, g, or t
  misc_feature (651)..(651): n is a, c, g, or t
  misc_feature (655)..(657): n is a, c, g, or t
  misc_feature (659)..(659): n is a, c, g, or t
cgtgtgctgggtgatctagaggcatccggtaggcctgaagcctgcagtccggcagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatngcgngcaccagctggccattgacacctaccaggagtttgaagaaacctatancncaaaggaccaggnactnnngnccagcgta

SEQ ID NO: 733951 - DNA, 835 bp, Homo sapiens
  misc_feature (213)..(213): n is a, c, g, or t
  misc_feature (805)..(805): n is a, c, g, or t
  misc_feature (807)..(807): n is a, c, g, or t
  misc_feature (809)..(809): n is a, c, g, or t
cgtgtgctgggtgatctagaggcatccggtaggcctgaagcctgcagtccggcagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733952 - DNA, 797 bp, Homo sapiens
  misc_feature (213)..(213): n is a, c, g, or t
  misc_feature (791)..(792): n is a, c, g, or t
cgtgtgctgggtgatctagaggcatccggtaggcctgaagcctgcagtccggcagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733953 - DNA, 752 bp, Homo sapiens
  misc_feature (213)..(213): n is a, c, g, or t
  misc_feature (694)..(694): n is a, c, g, or t
  misc_feature (729)..(729): n is a, c, g, or t
cgtgtgctgggtgatctagaggcatccggtaggcctgaagcctgcagtccggcagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733954 - DNA, 753 bp, Homo sapiens
  misc_feature (213)..(213): n is a, c, g, or t
  misc_feature (607)..(607): n is a, c, g, or t
  misc_feature (609)..(609): n is a, c, g, or t
  misc_feature (648)..(648): n is a, c, g, or t
  misc_feature (651)..(651): n is a, c, g, or t
  misc_feature (655)..(655): n is a, c, g, or t
  misc_feature (657)..(660): n is a, c, g, or t
  misc_feature (683)..(687): n is a, c, g, or t
  misc_feature (718)..(718): n is a, c, g, or t
cgtgtgctgggtgatctagaggcatccggtaggcctgaagcctgcagtccggcagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733955 - DNA, 424 bp, Homo sapiens
  misc_feature (394)..(394): n is a, c, g, or t
  misc_feature (396)..(396): n is a, c, g, or t
  misc_feature (398)..(398): n is a, c, g, or t
cactaggcagtggtgggcaaaagccaggagcagggacgtcaggagcctggagccattgccactaggtgagctgtccacaggaccctgagtggttcggggagttgtggccttgggatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733956 - DNA, 835 bp, Homo sapiens
  misc_feature (805)..(805): n is a, c, g, or t
  misc_feature (807)..(807): n is a, c, g, or t
  misc_feature (809)..(809): n is a, c, g, or t
gatgtagtcaggacgatgacgtgtggacagatgtactggtcagggaccgcactcggagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733957 - DNA, 797 bp, Homo sapiens
  misc_feature (791)..(792): n is a, c, g, or t
gatgtagtcaggacgatgacgtgtggacagatgtactggtcagggaccgcactcggagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733958 - DNA, 752 bp, Homo sapiens
  misc_feature (694)..(694): n is a, c, g, or t
  misc_feature (729)..(729): n is a, c, g, or t
gatgtagtcaggacgatgacgtgtggacagatgtactggtcagggaccgcactcggagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733959 - DNA, 753 bp, Homo sapiens
  misc_feature (607)..(607): n is a, c, g, or t
  misc_feature (609)..(609): n is a, c, g, or t
  misc_feature (648)..(648): n is a, c, g, or t
  misc_feature (651)..(651): n is a, c, g, or t
  misc_feature (655)..(655): n is a, c, g, or t
  misc_feature (657)..(660): n is a, c, g, or t
  misc_feature (683)..(687): n is a, c, g, or t
  misc_feature (718)..(718): n is a, c, g, or t
gatgtagtcaggacgatgacgtgtggacagatgtactggtcagggaccgcactcggagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733960 - DNA, 1026 bp, Homo sapiens
gatgtagtcaggacgatgacgtgtggacagatgtactggtcagggaccgcactcggagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaatagcttcgccgacaagcacttgacgtcactgctcaaagaagcttgacggggcttgctcatacatgactttcacggcaaatggtactatggcacaaagggtcgaggaacaattctctgggcggcattgtgctgccaggtggtcccgtcttcttgtgagatggtggcagccctggttgggtctttctgaagagtgccccagagtaggcatacctgtggactcccttcctctcaggtgccctctcgctgggggcccatggaaaagggtggggcactatcccaggtgtggccccgaacccgaagtccattggtttccctaaattaacatcactttaaaggttgggttattcttattcgcaaataataacccatgtaattaatggaatcaattaccagaatataagaacaatatttcgcgaggcctctcaattgtgggccgtatgaaaaagaatgttatgtaataaccgcag

SEQ ID NO: 733961 - DNA, 667 bp, Homo sapiens
  misc_feature (584)..(584): n is a, c, g, or t
  misc_feature (588)..(588): n is a, c, g, or t
  misc_feature (636)..(636): n is a, c, g, or t
  misc_feature (638)..(638): n is a, c, g, or t
  misc_feature (651)..(651): n is a, c, g, or t
  misc_feature (655)..(657): n is a, c, g, or t
  misc_feature (659)..(659): n is a, c, g, or t
gatgtagtcaggacgatgacgtgtggacagatgtactggtcagggaccgcactcggagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatngcgngcaccagctggccattgacacctaccaggagtttgaagaaacctatancncaaaggaccaggnactnnngnccagcgta

SEQ ID NO: 733962 - DNA, 1048 bp, Homo sapiens
  misc_feature (504)..(504): n is a, c, g, or t
  misc_feature (511)..(511): n is a, c, g, or t
  misc_feature (519)..(519): n is a, c, g, or t
  misc_feature (524)..(526): n is a, c, g, or t
  misc_feature (537)..(538): n is a, c, g, or t
  misc_feature (540)..(540): n is a, c, g, or t
  misc_feature (543)..(543): n is a, c, g, or t
  misc_feature (552)..(552): n is a, c, g, or t
  misc_feature (554)..(554): n is a, c, g, or t
  misc_feature (561)..(561): n is a, c, g, or t
  misc_feature (565)..(565): n is a, c, g, or t
  misc_feature (569)..(569): n is a, c, g, or t
  misc_feature (571)..(573): n is a, c, g, or t
  misc_feature (577)..(577): n is a, c, g, or t
  misc_feature (580)..(580): n is a, c, g, or t
  misc_feature (582)..(582): n is a, c, g, or t
  misc_feature (597)..(597): n is a, c, g, or t
  misc_feature (608)..(608): n is a, c, g, or t
  misc_feature (611)..(611): n is a, c, g, or t
  misc_feature (626)..(626): n is a, c, g, or t
  misc_feature (644)..(644): n is a, c, g, or t
  misc_feature (653)..(653): n is a, c, g, or t
  misc_feature (658)..(658): n is a, c, g, or t
  misc_feature (680)..(680): n is a, c, g, or t
  misc_feature (701)..(701): n is a, c, g, or t
  misc_feature (703)..(703): n is a, c, g, or t
  misc_feature (708)..(708): n is a, c, g, or t
  misc_feature (710)..(710): n is a, c, g, or t
  misc_feature (712)..(712): n is a, c, g, or t
  misc_feature (714)..(716): n is a, c, g, or t
  misc_feature (718)..(718): n is a, c, g, or t
  misc_feature (720)..(720): n is a, c, g, or t
  misc_feature (724)..(724): n is a, c, g, or t
  misc_feature (726)..(726): n is a, c, g, or t
  misc_feature (728)..(728): n is a, c, g, or t
  misc_feature (1042)..(1043): n is a, c, g, or t
gatgtagtcaggacgatgacgtgtggacagatgtactggtcagggaccgcactcggagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcnccagggntccccaancctgnnnccccactggcnncnagngctggggananaaacacngctncccncnnnttancantnaggcgctgacccaanagaactcaccntantcttcatttcccctngtgaatcctccaggcctntctctacancctgnaggggagggaggaaaatggatnaatgagagagggagggaacantnccaancncntnnncncncccncncntccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733963 - DNA, 1086 bp, Homo sapiens
  misc_feature (504)..(504): n is a, c, g, or t
  misc_feature (511)..(511): n is a, c, g, or t
  misc_feature (519)..(519): n is a, c, g, or t
  misc_feature (524)..(526): n is a, c, g, or t
  misc_feature (537)..(538): n is a, c, g, or t
  misc_feature (540)..(540): n is a, c, g, or t
  misc_feature (543)..(543): n is a, c, g, or t
  misc_feature (552)..(552): n is a, c, g, or t
  misc_feature (554)..(554): n is a, c, g, or t
  misc_feature (561)..(561): n is a, c, g, or t
  misc_feature (565)..(565): n is a, c, g, or t
  misc_feature (569)..(569): n is a, c, g, or t
  misc_feature (571)..(573): n is a, c, g, or t
  misc_feature (577)..(577): n is a, c, g, or t
  misc_feature (580)..(580): n is a, c, g, or t
  misc_feature (582)..(582): n is a, c, g, or t
  misc_feature (597)..(597): n is a, c, g, or t
  misc_feature (608)..(608): n is a, c, g, or t
  misc_feature (611)..(611): n is a, c, g, or t
  misc_feature (626)..(626): n is a, c, g, or t
  misc_feature (644)..(644): n is a, c, g, or t
  misc_feature (653)..(653): n is a, c, g, or t
  misc_feature (658)..(658): n is a, c, g, or t
  misc_feature (680)..(680): n is a, c, g, or t
  misc_feature (701)..(701): n is a, c, g, or t
  misc_feature (703)..(703): n is a, c, g, or t
  misc_feature (708)..(708): n is a, c, g, or t
  misc_feature (710)..(710): n is a, c, g, or t
  misc_feature (712)..(712): n is a, c, g, or t
  misc_feature (714)..(716): n is a, c, g, or t
  misc_feature (718)..(718): n is a, c, g, or t
  misc_feature (720)..(720): n is a, c, g, or t
  misc_feature (724)..(724): n is a, c, g, or t
  misc_feature (726)..(726): n is a, c, g, or t
  misc_feature (728)..(728): n is a, c, g, or t
  misc_feature (1056)..(1056): n is a, c, g, or t
  misc_feature (1058)..(1058): n is a, c, g, or t
  misc_feature (1060)..(1060): n is a, c, g, or t
gatgtagtcaggacgatgacgtgtggacagatgtactggtcagggaccgcactcggagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcnccagggntccccaancctgnnnccccactggcnncnagngctggggananaaacacngctncccncnnnttancantnaggcgctgacccaanagaactcaccntantcttcatttcccctngtgaatcctccaggcctntctctacancctgnaggggagggaggaaaatggatnaatgagagagggagggaacantnccaancncntnnncncncccncncntccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733964 - DNA, 670 bp, Homo sapiens
  misc_feature (216)..(216): n is a, c, g, or t
  misc_feature (587)..(587): n is a, c, g, or t
  misc_feature (591)..(591): n is a, c, g, or t
  misc_feature (639)..(639): n is a, c, g, or t
  misc_feature (641)..(641): n is a, c, g, or t
  misc_feature (654)..(654): n is a, c, g, or t
  misc_feature (658)..(660): n is a, c, g, or t
  misc_feature (662)..(662): n is a, c, g, or t
gatgtagtcaggacgatgacgtgtggacagatgtactggtcagggaccgcactcggagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatngcgngcaccagctggccattgacacctaccaggagtttgaagaaacctatancncaaaggaccaggnactnnngnccagcgta

SEQ ID NO: 733965 - DNA, 838 bp, Homo sapiens
  misc_feature (216)..(216): n is a, c, g, or t
  misc_feature (808)..(808): n is a, c, g, or t
  misc_feature (810)..(810): n is a, c, g, or t
  misc_feature (812)..(812): n is a, c, g, or t
gatgtagtcaggacgatgacgtgtggacagatgtactggtcagggaccgcactcggagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733966 - DNA, 800 bp, Homo sapiens
  misc_feature (216)..(216): n is a, c, g, or t
  misc_feature (794)..(795): n is a, c, g, or t
gatgtagtcaggacgatgacgtgtggacagatgtactggtcagggaccgcactcggagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733967 - DNA, 755 bp, Homo sapiens
  misc_feature (216)..(216): n is a, c, g, or t
  misc_feature (697)..(697): n is a, c, g, or t
  misc_feature (732)..(732): n is a, c, g, or t
gatgtagtcaggacgatgacgtgtggacagatgtactggtcagggaccgcactcggagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733968 - DNA, 756 bp, Homo sapiens
  misc_feature (216)..(216): n is a, c, g, or t
  misc_feature (610)..(610): n is a, c, g, or t
  misc_feature (612)..(612): n is a, c, g, or t
  misc_feature (651)..(651): n is a, c, g, or t
  misc_feature (654)..(654): n is a, c, g, or t
  misc_feature (658)..(658): n is a, c, g, or t
  misc_feature (660)..(663): n is a, c, g, or t
  misc_feature (686)..(690): n is a, c, g, or t
  misc_feature (721)..(721): n is a, c, g, or t
gatgtagtcaggacgatgacgtgtggacagatgtactggtcagggaccgcactcggagtcctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733969 - DNA, 825 bp, Homo sapiens
  misc_feature (10)..(10): n is a, c, g, or t
  misc_feature (819)..(820): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733970 - DNA, 780 bp, Homo sapiens
  misc_feature (10)..(10): n is a, c, g, or t
  misc_feature (722)..(722): n is a, c, g, or t
  misc_feature (757)..(757): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733971 - DNA, 695 bp, Homo sapiens
  misc_feature (10)..(10): n is a, c, g, or t
  misc_feature (612)..(612): n is a, c, g, or t
  misc_feature (616)..(616): n is a, c, g, or t
  misc_feature (664)..(664): n is a, c, g, or t
  misc_feature (666)..(666): n is a, c, g, or t
  misc_feature (679)..(679): n is a, c, g, or t
  misc_feature (683)..(685): n is a, c, g, or t
  misc_feature (687)..(687): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatngcgngcaccagctggccattgacacctaccaggagtttgaagaaacctatancncaaaggaccaggnactnnngnccagcgta

SEQ ID NO: 733972 - DNA, 1054 bp, Homo sapiens
  misc_feature (10)..(10): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaatagcttcgccgacaagcacttgacgtcactgctcaaagaagcttgacggggcttgctcatacatgactttcacggcaaatggtactatggcacaaagggtcgaggaacaattctctgggcggcattgtgctgccaggtggtcccgtcttcttgtgagatggtggcagccctggttgggtctttctgaagagtgccccagagtaggcatacctgtggactcccttcctctcaggtgccctctcgctgggggcccatggaaaagggtggggcactatcccaggtgtggccccgaacccgaagtccattggtttccctaaattaacatcactttaaaggttgggttattcttattcgcaaataataacccatgtaattaatggaatcaattaccagaatataagaacaatatttcgcgaggcctctcaattgtgggccgtatgaaaaagaatgttatgtaataaccgcag

SEQ ID NO: 733973 - DNA, 1076 bp, Homo sapiens
  misc_feature (10)..(10): n is a, c, g, or t
  misc_feature (532)..(532): n is a, c, g, or t
  misc_feature (539)..(539): n is a, c, g, or t
  misc_feature (547)..(547): n is a, c, g, or t
  misc_feature (552)..(554): n is a, c, g, or t
  misc_feature (565)..(566): n is a, c, g, or t
  misc_feature (568)..(568): n is a, c, g, or t
  misc_feature (571)..(571): n is a, c, g, or t
  misc_feature (580)..(580): n is a, c, g, or t
  misc_feature (582)..(582): n is a, c, g, or t
  misc_feature (589)..(589): n is a, c, g, or t
  misc_feature (593)..(593): n is a, c, g, or t
  misc_feature (597)..(597): n is a, c, g, or t
  misc_feature (599)..(601): n is a, c, g, or t
  misc_feature (605)..(605): n is a, c, g, or t
  misc_feature (608)..(608): n is a, c, g, or t
  misc_feature (610)..(610): n is a, c, g, or t
  misc_feature (625)..(625): n is a, c, g, or t
  misc_feature (636)..(636): n is a, c, g, or t
  misc_feature (639)..(639): n is a, c, g, or t
  misc_feature (654)..(654): n is a, c, g, or t
  misc_feature (672)..(672): n is a, c, g, or t
  misc_feature (681)..(681): n is a, c, g, or t
  misc_feature (686)..(686): n is a, c, g, or t
  misc_feature (708)..(708): n is a, c, g, or t
  misc_feature (729)..(729): n is a, c, g, or t
  misc_feature (731)..(731): n is a, c, g, or t
  misc_feature (736)..(736): n is a, c, g, or t
  misc_feature (738)..(738): n is a, c, g, or t
  misc_feature (740)..(740): n is a, c, g, or t
  misc_feature (742)..(744): n is a, c, g, or t
  misc_feature (746)..(746): n is a, c, g, or t
  misc_feature (748)..(748): n is a, c, g, or t
  misc_feature (752)..(752): n is a, c, g, or t
  misc_feature (754)..(754): n is a, c, g, or t
  misc_feature (756)..(756): n is a, c, g, or t
  misc_feature (1070)..(1071): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcnccagggntccccaancctgnnnccccactggcnncnagngctggggananaaacacngctncccncnnnttancantnaggcgctgacccaanagaactcaccntantcttcatttcccctngtgaatcctccaggcctntctctacancctgnaggggagggaggaaaatggatnaatgagagagggagggaacantnccaancncntnnncncncccncncntccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733974 - DNA, 1114 bp, Homo sapiens
  misc_feature (10)..(10): n is a, c, g, or t
  misc_feature (532)..(532): n is a, c, g, or t
  misc_feature (539)..(539): n is a, c, g, or t
  misc_feature (547)..(547): n is a, c, g, or t
  misc_feature (552)..(554): n is a, c, g, or t
  misc_feature (565)..(566): n is a, c, g, or t
  misc_feature (568)..(568): n is a, c, g, or t
  misc_feature (571)..(571): n is a, c, g, or t
  misc_feature (580)..(580): n is a, c, g, or t
  misc_feature (582)..(582): n is a, c, g, or t
  misc_feature (589)..(589): n is a, c, g, or t
  misc_feature (593)..(593): n is a, c, g, or t
  misc_feature (597)..(597): n is a, c, g, or t
  misc_feature (599)..(601): n is a, c, g, or t
  misc_feature (605)..(605): n is a, c, g, or t
  misc_feature (608)..(608): n is a, c, g, or t
  misc_feature (610)..(610): n is a, c, g, or t
  misc_feature (625)..(625): n is a, c, g, or t
  misc_feature (636)..(636): n is a, c, g, or t
  misc_feature (639)..(639): n is a, c, g, or t
  misc_feature (654)..(654): n is a, c, g, or t
  misc_feature (672)..(672): n is a, c, g, or t
  misc_feature (681)..(681): n is a, c, g, or t
  misc_feature (686)..(686): n is a, c, g, or t
  misc_feature (708)..(708): n is a, c, g, or t
  misc_feature (729)..(729): n is a, c, g, or t
  misc_feature (731)..(731): n is a, c, g, or t
  misc_feature (736)..(736): n is a, c, g, or t
  misc_feature (738)..(738): n is a, c, g, or t
  misc_feature (740)..(740): n is a, c, g, or t
  misc_feature (742)..(744): n is a, c, g, or t
  misc_feature (746)..(746): n is a, c, g, or t
  misc_feature (748)..(748): n is a, c, g, or t
  misc_feature (752)..(752): n is a, c, g, or t
  misc_feature (754)..(754): n is a, c, g, or t
  misc_feature (756)..(756): n is a, c, g, or t
  misc_feature (1084)..(1084): n is a, c, g, or t
  misc_feature (1086)..(1086): n is a, c, g, or t
  misc_feature (1088)..(1088): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcnccagggntccccaancctgnnnccccactggcnncnagngctggggananaaacacngctncccncnnnttancantnaggcgctgacccaanagaactcaccntantcttcatttcccctngtgaatcctccaggcctntctctacancctgnaggggagggaggaaaatggatnaatgagagagggagggaacantnccaancncntnnncncncccncncntccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733975 - DNA, 698 bp, Homo sapiens
  misc_feature (10)..(10): n is a, c, g, or t
  misc_feature (244)..(244): n is a, c, g, or t
  misc_feature (615)..(615): n is a, c, g, or t
  misc_feature (619)..(619): n is a, c, g, or t
  misc_feature (667)..(667): n is a, c, g, or t
  misc_feature (669)..(669): n is a, c, g, or t
  misc_feature (682)..(682): n is a, c, g, or t
  misc_feature (686)..(688): n is a, c, g, or t
  misc_feature (690)..(690): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatngcgngcaccagctggccattgacacctaccaggagtttgaagaaacctatancncaaaggaccaggnactnnngnccagcgta

SEQ ID NO: 733976 - DNA, 828 bp, Homo sapiens
  misc_feature (10)..(10): n is a, c, g, or t
  misc_feature (244)..(244): n is a, c, g, or t
  misc_feature (822)..(823): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733977 - DNA, 783 bp, Homo sapiens
  misc_feature (10)..(10): n is a, c, g, or t
  misc_feature (244)..(244): n is a, c, g, or t
  misc_feature (725)..(725): n is a, c, g, or t
  misc_feature (760)..(760): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccagtgagttttgaagaanacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733978 - DNA, 695 bp, Homo sapiens
  misc_feature (10)..(10): n is a, c, g, or t
  misc_feature (214)..(214): n is a, c, g, or t
  misc_feature (612)..(612): n is a, c, g, or t
  misc_feature (616)..(616): n is a, c, g, or t
  misc_feature (664)..(664): n is a, c, g, or t
  misc_feature (666)..(666): n is a, c, g, or t
  misc_feature (679)..(679): n is a, c, g, or t
  misc_feature (683)..(685): n is a, c, g, or t
  misc_feature (687)..(687): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagagggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatngcgngcaccagctggccattgacacctaccaggagtttgaagaaacctatancncaaaggaccaggnactnnngnccagcgta

SEQ ID NO: 733979 - DNA, 825 bp, Homo sapiens
  misc_feature (10)..(10): n is a, c, g, or t
  misc_feature (214)..(214): n is a, c, g, or t
  misc_feature (819)..(820): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagagggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733980 - DNA, 780 bp, Homo sapiens
  misc_feature (10)..(10): n is a, c, g, or t
  misc_feature (214)..(214): n is a, c, g, or t
  misc_feature (722)..(722): n is a, c, g, or t
  misc_feature (757)..(757): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagagggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733981 - DNA, 1054 bp, Homo sapiens
  misc_feature (10)..(10): n is a, c, g, or t
  misc_feature (214)..(214): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagagggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaatagcttcgccgacaagcacttgacgtcactgctcaaagaagcttgacggggcttgctcatacatgactttcacggcaaatggtactatggcacaaagggtcgaggaacaattctctgggcggcattgtgctgccaggtggtcccgtcttcttgtgagatggtggcagccctggttgggtctttctgaagagtgccccagagtaggcatacctgtggactcccttcctctcaggtgccctctcgctgggggcccatggaaaagggtggggcactatcccaggtgtggccccgaacccgaagtccattggtttccctaaattaacatcactttaaaggttgggttattcttattcgcaaataataacccatgtaattaatggaatcaattaccagaatataagaacaatatttcgcgaggcctctcaattgtgggccgtatgaaaaagaatgttatgtaataaccgcag

SEQ ID NO: 733982 - DNA, 727 bp, Homo sapiens
  misc_feature (10)..(10): n is a, c, g, or t
  misc_feature (644)..(644): n is a, c, g, or t
  misc_feature (648)..(648): n is a, c, g, or t
  misc_feature (696)..(696): n is a, c, g, or t
  misc_feature (698)..(698): n is a, c, g, or t
  misc_feature (711)..(711): n is a, c, g, or t
  misc_feature (715)..(717): n is a, c, g, or t
  misc_feature (719)..(719): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggcttggtcgcccgtcacaaaccgtgtcgcgtatatcacaggcttttttagacacagcggatattgctctcagagccccacttcggcggcgcaccagcttgggacactcagacaccctacccagggatgttgtgggatgacacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatngcgngcaccagctggccattgacacctaccaggagtttgaagaaacctatancncaaaggaccaggnactnnngnccagcgta

SEQ ID NO: 733983 - DNA, 895 bp, Homo sapiens
  misc_feature (10)..(10): n is a, c, g, or t
  misc_feature (865)..(865): n is a, c, g, or t
  misc_feature (867)..(867): n is a, c, g, or t
  misc_feature (869)..(869): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggcttggtcgcccgtcacaaaccgtgtcgcgtatatcacaggcttttttagacacagcggatattgctctcagagccccacttcggcggcgcaccagcttgggacactcagacaccctacccagggatgttgtgggatgacacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatcatttcaaaaaanancncaaaacaacacaaaacacaaacatcc

SEQ ID NO: 733984 - DNA, 857 bp, Homo sapiens
  misc_feature (10)..(10): n is a, c, g, or t
  misc_feature (851)..(852): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggcttggtcgcccgtcacaaaccgtgtcgcgtatatcacaggcttttttagacacagcggatattgctctcagagccccacttcggcggcgcaccagcttgggacactcagacaccctacccagggatgttgtgggatgacacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733985 - DNA, 812 bp, Homo sapiens
  misc_feature (10)..(10): n is a, c, g, or t
  misc_feature (754)..(754): n is a, c, g, or t
  misc_feature (789)..(789): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggcttggtcgcccgtcacaaaccgtgtcgcgtatatcacaggcttttttagacacagcggatattgctctcagagccccacttcggcggcgcaccagcttgggacactcagacaccctacccagggatgttgtgggatgacacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggaactgtggtttactgccggnggatcctggacctccagtgcttctgcctgagtgcntcaggccacactgctattagtgt

SEQ ID NO: 733986 - DNA, 813 bp, Homo sapiens
  misc_feature (10)..(10): n is a, c, g, or t
  misc_feature (667)..(667): n is a, c, g, or t
  misc_feature (669)..(669): n is a, c, g, or t
  misc_feature (708)..(708): n is a, c, g, or t
  misc_feature (711)..(711): n is a, c, g, or t
  misc_feature (715)..(715): n is a, c, g, or t
  misc_feature (717)..(720): n is a, c, g, or t
  misc_feature (743)..(747): n is a, c, g, or t
  misc_feature (778)..(778): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagaggcttggtcgcccgtcacaaaccgtgtcgcgtatatcacaggcttttttagacacagcggatattgctctcagagccccacttcggcggcgcaccagcttgggacactcagacaccctacccagggatgttgtgggatgacacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagttacacaaactacagaaacaaccaataaacgcacagctacaagaacaacgagacatgntnaaacagctatacgaggaaagaaacaatagaaacaaaggncanaaanannnnagacagacaatagagaagaaagnnnnnctctgtggaagaagacaagaatgtggcttcnaggtagacaccaaagataagacaaaacaaaaaccc

SEQ ID NO: 733987 - DNA, 858 bp, Homo sapiens
  misc_feature (10)..(10): n is a, c, g, or t
  misc_feature (214)..(214): n is a, c, g, or t
  misc_feature (360)..(360): n is a, c, g, or t
  misc_feature (364)..(364): n is a, c, g, or t
  misc_feature (366)..(366): n is a, c, g, or t
  misc_feature (370)..(370): n is a, c, g, or t
ccggaggcgnttgaatggccccctcgaaccactcagggtcctgtggacagctcacctagtggcaatggctccaggctcccggacgtccctgctcctggcttttgccctgctctgcctgccctggcttcaagagggcagtgccttcccaaccattcccttatccaggctttttgacaacgctatgctccgcgcccatcgtctgcaccagctggcntttgacacctaccaggagtttgaagaaacctatatcccaaaggaccagaagtattcattcctggagaaaccccagaactccctctggtttctcagagtctattccgacaacctccaacaggggaggaaacacaacagaaatccaanctananctgntccgcatctccctgtgtggtcatccaatcgtgggtggagcccgtggcagttcctcaggagtgtcttcggcaacaggctggtggtacgggggctctgacaggaacgtctatgaactcctaaaggaactagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtgagggcagtggggttctactgccggtggatccgggaacctccaggccctggccggaatgctcatgcccactggcaaaaaaatgtcaacaaaacaaaagacagcccacaacaccaggggcaccatgatggggcacgggaggaatatcccggaccccgg

SEQ ID NO: 733988 - DNA, 457 bp, Homo sapiens
  misc_feature (451)..(452): n is a, c, g, or t
tcgagcggccgcccgggcaggtcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggacgggcagcgtgtgtgcttctagtgtgcccgagtagcatcctgtgacccctccccagtgcctctcctggccctgaaggtgccactccatgtgcccaccatgcccggtgtaccggagctcgnnaattc

SEQ ID NO: 733989 - DNA, 1161 bp, Homo sapiens
cactcctgagagcagagctggccgcagccatgaccccgcagcttctcctggcccttgtcctctgggccagctgcccgccctgcagtggaaggaaagggcccccagcagctctgacactgccccgggtgcaatgccgagcctctcggtacccgatcgccgtggattgctcctggaccctgccgcctgctccaaactccaccagccccgtgtccttcattgccacgtacaggctcggcatggctgcccggggccacagctggccctgcctgcagcagacgccaacgtccaccagctgcaccatcacggatgtccagctgttctccatggctccctacgtgctcaatgtcaccgccgtccacccctggggctccagcagcagcttcgtgcctttcataacagagcacatcatcaagcccgaccctccagaaggcgtgcgcctaagccccctcgctgagcgccagctacaggtgcagtgggagcctcccgggtcctggcccttcccagagatcttctcactgaagtactggatccgttacaagcgtcagggagctgcgcgcttccaccgggtggggcccattgaagccacgtccttcatcctcagggctgtgcggccccgagccaggtactacgtccaagtggcggctcaggacctcacagactacggggaactgagtgactggagtctccccgccactgccacaatgagcctgggcaagtagcaagggcttcccgctgcctccagacagcacctgggtcctcgccaccctaagccccgggacacctgttggagggcggatggggatctgcctagcctgggctggagtccttgctttgctgctgctgagctgccgggcaacctcagatgaccgacttttcccctttgagcctcagtttctctagctgagaaatggagatgtactactctctcctttacctttacctttaccacagtgcagggctgactgaactgtcactgtgagatattttttattgtttaattagaaaagaattgttgttgggctgggcgcagtggatcgcacctgtaatcccagtcactgggaagccgacgtgggagggtagcttgaggccaggagctcgaaaccagtccgggccacacagcaagaccccatctctaaaaaattaatataaatataaaataaa

SEQ ID NO: 733990 - DNA, 380 bp, Homo sapiens
ggtgtgatgttgcgcgcccacagtcccaactacttgggaggctgaggtgggaggatcacttgagtccaggaggttaaggctgcagtgagctgtcgtcacaccactgccttcatgcctgggcaacagagcaagaccctggtttttttgtttgtttgtttgtttgttttaatcatagttgaggccgggtgcggtggctcgcgcctgtaatcccgacgccgaggcgggcagatcacgaggtcaggagttcgagaccagcctgaccaacatggtgaaacccggtctctactaaaaatacagaaattagctgggcatggtggcctgagcccgtaaccccagctactcaggaggctaaggcaggagaatcgcttgaacctgggagg

SEQ ID NO: 733991 - DNA, 772 bp, Homo sapiens; identical to SEQ ID NO: 299745

SEQ ID NO: 733992 - DNA, 870 bp, Homo sapiens; identical to SEQ ID NO: 299746

SEQ ID NO: 733993 - DNA, 625 bp, Homo sapiens
aactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggtatgtatcctctggggaaaggagtgggagggagcaagtgggttgttgcaaaatgagctttcccgtattttccatctagtcgactggtgtgagtttaacattgcatttggtggaaatctaagactggcacacatgcaactcattgagggggtcctgttaaccctgcaagtgatggatgccttgcctctgtgatggcctcagtccgcccacctaggttccagggcttattaacccttgagctctttcatggtttcctcacactgtgttctctgctctacgtcagcaacctctctgtgccgatgttgagaagaaacttcatatgcaaccttgctttatcggtgacctcagattctttgtggagaatttggaaa

SEQ ID NO: 733994 - DNA, 424 bp, Homo sapiens
aactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacgtagggctaagggagggggcgctggagcttccaacccgaggcaataaaagaaatgttgcgtaactca

SEQ ID NO: 733995 - DNA, 731 bp, Homo sapiens
atgctctctctggtggggagaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggctgagggcgcaggtgcggggcagtgaacttcagaccccaaaggagtcagagcatgtggggcgggggcgggggggggcaacgtagggctaagggagggggcgctggagcttccaacccgaggcaataaaagaaatgttgcgtaactca

SEQ ID NO: 733996 - DNA, 736 bp, Homo sapiens
  misc_feature (16)..(16): n is a, c, g, or t
cctgtcagtcgcttcntggcctgtcaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggctgagggcgcaggtgcggggcagtgaacttcagaccccaaaggagtcagagcatgtggggcgggggcgggggggggcaacgtagggctaagggagggggcgctggagcttccaacccgaggcaataaaagaaatgttgcgtaactca

SEQ ID NO: 733997 - DNA, 646 bp, Homo sapiens
  misc_feature (16)..(16): n is a, c, g, or t
cctgtcagtcgcttcntggcctgtcaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcacgctgggcggggctgagggcgcaggtgcggggcagtgaacttcagaccccaaaggagtcagagcatgtggggcgggggcgggggggggcaacgtagggctaagggagggggcgctggagcttccaacccgaggcaataaaagaaatgttgcgtaactca

SEQ ID NO: 733998 - DNA, 599 bp, Homo sapiens; identical to SEQ ID NO: 299754
  misc_feature (16)..(16): n is a, c, g, or t

SEQ ID NO: 733999 - DNA, 641 bp, Homo sapiens
atgctctctctggtggggagaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcacgctgggcggggctgagggcgcaggtgcggggcagtgaacttcagaccccaaaggagtcagagcatgtggggcgggggcgggggggggcaacgtagggctaagggagggggcgctggagcttccaacccgaggcaataaaagaaatgttgcgtaactca

SEQ ID NO: 734000 - DNA, 594 bp, Homo sapiens
atgctctctctggtggggagaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccacagggaaccacggcagaagcgctgggcggggctgagggcgcaggtgcggggcagtgaacttcagaccccaaaggagtcagagcatgtggggcgggggcgggggggggcaacgtagggctaagggagggggcgctggagcttccaacccgaggcaataaaagaaatgttgcgtaactca

SEQ ID NO: 734001 - DNA, 896 bp, Homo sapiens
ggtcagccagtcctgagcacctaaccatgttgggcatcactgtcctcgctgcgctcttggcctgtgcctccagctgtggggtgcccagcttcccgcccaacctatccgcccgagtggtgggaggagaggatgcccggccccacagctggccctggcagatctccctccagtacctcaagaacgacacgtggaggcatacgtgtggcgggactttgattgctagcaacttcgtcctcactgccgcccactgcatcagcaacacccggacctaccgtgtggccgtgggaaagaacaacctggaggtggaagacgaagaaggatccctgtttgtgggtgtggacaccatccacgtccacaagagatggaatgccctcctgttgcgcaatgatattgccctcatcaagcttgcagagcatgtggagctgagtgacaccatccaggtggcctgcctgccagagaaggactccctgctccccaaggactacccctgctatgtcaccggctggggccgcctctggaccaacggccccattgctgataagctgcagcagggcctgcagcccgtggtggatcacgccacgtgctccaggattgactggtggggcttcagggtgaagaaaaccatggtgtgcgctgggggcgatggcgtcatctcagcctgcaatggggactccggtggcccactgaactgccagttggagaacggttcctgggaggtgtttggcatcgtcagctttggctcccggcggggctgcaacacccgcaagaagccggtagtctacacccgggtgtccgcctacatcgactggatcaacgagaaaatgcagctgtgatttgttgctgggagcggcggcagcgagtccctgcaacagcaataaacttccttctcctcgggc

SEQ ID NO: 734002 - DNA, 750 bp, Homo sapiens
ggtcagccagtcctgagcacctaaccatgttgggcatcactgtcctcgctgcgctcttggcctgtgcctccagctgtggggtgcccagcttcccgcccaacctatccgcccgagtggtgggaggagaggatgcccggccccacagctggccctggcagatctccctccagtacctcaagaacgacacgtggaggcatacgtgtggcgggactttgattgctagcaacttcgtcctcactgccgcccactgcatcagcaacacccggacctaccgtgtggccgtgggaaagaacaacctggaggtggaagacgaagaaggatccctgtttgtgggtgtggacaccatccacgtccacaagagatggaatgccctcctgttgcgcaatgatattgccctcatcaagcttgcagagcatgtggagctgagtgacaccatccaggtggcctgcctgccagagaaggactccctgctccccaaggactacccctgctatgtcaccggctggggccgcctctggaggggactccggtggcccactgaactgccagttggagaacggttcctgggaggtgtttggcatcgtcagctttggctcccggcggggctgcaacacccgcaagaagccggtagtctacacccgggtgtccgcctacatcgactggatcaacgagaaaatgcagctgtgatttgttgctgggagcggcggcagcgagtccctgcaacagcaataaacttccttctcctcgggc

SEQ ID NO: 734003 - DNA, 434 bp, Homo sapiens
tgggagcctggctgggtctttctcagcagaagttgtttccaggtgtgctcaggtgccttcctctagcagagcacagaaagctagaataccccccagggagacagggatgccaagagtagaccagagctgggacccacagacagaacctccacctgcctgctgcccactgagctgggacctggtcaccttggattttagccggcctctttctggctataacaggcagagtcggagctgcctcccaccccagtcagaagcctggcaccccctctgcttcggccagatgtgctggctgactccgacttccgaccagcactcagctggcctctggggattctagctccacaaccaggccgtgaggctggagaaactggcagttattgctgtcaaaagcctgttctctcaactgctgtcaataaaattaaagatacaga

SEQ ID NO: 734004 - DNA, 3345 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaa

SEQ ID NO: 734005 - DNA, 6043 bp, Homo sapiens; identical to SEQ ID NO: 318524

SEQ ID NO: 734006 - DNA, 563 bp, Homo sapiens; identical to SEQ ID NO: 318546

SEQ ID NO: 734007 - DNA, 521 bp, Homo sapiens
cctcttggtctttcttgctttttgcagccatttaaggtgtgatgtttgcattcagtgagtgcatactccataagaccctgtcaaacaaatgccattcccctttccaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtacgtggccgccacaagctcggcatcaggagaggcactggcagacctgggctgtgggactgggggcatgtgctctgttttggttagcccccactcctggcgggcgctgtccacacagcatccggtgt

SEQ ID NO: 734008 - DNA, 769 bp, Homo sapiens; identical to SEQ ID NO: 318522

SEQ ID NO: 734009 - DNA, 1132 bp, Homo sapiens; identical to SEQ ID NO: 318521

SEQ ID NO: 734010 - DNA, 3684 bp, Homo sapiens
  misc_feature (3347)..(3347): n is a, c, g, or t
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaaanaaaaaaaaaaaaaaaaaaaaaaaaatttgtgggggggctgcgggccctgagaaaaagtttttaaaaccttcggtgggggggcggggcgcccagtagtgtacttgtcagaccttggcgccataggctggtttccagaggaagatccgggcgcccatgagactcatgggtgcttggtgttccttcctccccagttaaataaaaagccgccgcgggggggaacccggagctgtttctggaaccaattcccagaagtagggaggttccgaggggcgccctcacgggaggcgtttatccaccaggggagttccagggagagtcccgattttaaaattagtcg

SEQ ID NO: 734011 - DNA, 1866 bp, Homo sapiens
  misc_feature (1529)..(1529): n is a, c, g, or t
atccctgcccgatcttctctgaggctccttgctctctgctttgactgagtggctgagtttgccagttccttagcctgcgacacttttcttaactaaggtcatttctatagtgaactgctgaatgggtatgaatgtcatcactgtatcaaagtactttgtaaaggccgacatctgtgtggtagggtgacaaggtgtgaagtttaatgccttttaaaaatcttactggaaagacacccacctcttagtaaaggtgacagtcacggcagcagtgggagtcattgcaacagcttttgcatatggaatgatgtgtgcaggtgctgtgtggtgcattttatgcccatgatgtcatcccctccttatacaactctgaagaaggtggtatgattcttttctcacatacctaggacctgaggctcagggaagttaagtaatttgcctaatgtgatctcgctaagatttacacacacacaggtctgcctgtcccccaagaagctcttagtagcagctgtgcttgaactcgtggccatttctcctcggatgacctttagaaatggtttactggtgcggtgctgttttctctgagttcttattgggcaattcaggggcaagtctaaatgatgcctcttttcgagggaaaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaaanaaaaaaaaaaaaaaaaaaaaaaaaatttgtgggggggctgcgggccctgagaaaaagtttttaaaaccttcggtgggggggcggggcgcccagtagtgtacttgtcagaccttggcgccataggctggtttccagaggaagatccgggcgcccatgagactcatgggtgcttggtgttccttcctccccagttaaataaaaagccgccgcgggggggaacccggagctgtttctggaaccaattcccagaagtagggaggttccgaggggcgccctcacgggaggcgtttatccaccaggggagttccagggagagtcccgattttaaaattagtcg

SEQ ID NO: 734012 - DNA, 1527 bp, Homo sapiens
atccctgcccgatcttctctgaggctccttgctctctgctttgactgagtggctgagtttgccagttccttagcctgcgacacttttcttaactaaggtcatttctatagtgaactgctgaatgggtatgaatgtcatcactgtatcaaagtactttgtaaaggccgacatctgtgtggtagggtgacaaggtgtgaagtttaatgccttttaaaaatcttactggaaagacacccacctcttagtaaaggtgacagtcacggcagcagtgggagtcattgcaacagcttttgcatatggaatgatgtgtgcaggtgctgtgtggtgcattttatgcccatgatgtcatcccctccttatacaactctgaagaaggtggtatgattcttttctcacatacctaggacctgaggctcagggaagttaagtaatttgcctaatgtgatctcgctaagatttacacacacacaggtctgcctgtcccccaagaagctcttagtagcagctgtgcttgaactcgtggccatttctcctcggatgacctttagaaatggtttactggtgcggtgctgttttctctgagttcttattgggcaattcaggggcaagtctaaatgatgcctcttttcgagggaaaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaa

SEQ ID NO: 734013 - DNA, 1845 bp, Homo sapiens; identical to SEQ ID NO: 318537

SEQ ID NO: 734014 - DNA, 1102 bp, Homo sapiens
  misc_feature (765)..(765): n is a, c, g, or t
tagaggatccccggtgtttatcgatgccacagatcaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaaanaaaaaaaaaaaaaaaaaaaaaaaaatttgtgggggggctgcgggccctgagaaaaagtttttaaaaccttcggtgggggggcggggcgcccagtagtgtacttgtcagaccttggcgccataggctggtttccagaggaagatccgggcgcccatgagactcatgggtgcttggtgttccttcctccccagttaaataaaaagccgccgcgggggggaacccggagctgtttctggaaccaattcccagaagtagggaggttccgaggggcgccctcacgggaggcgtttatccaccaggggagttccagggagagtcccgattttaaaattagtcg

SEQ ID NO: 734015 - DNA, 763 bp, Homo sapiens
tagaggatccccggtgtttatcgatgccacagatcaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaa

SEQ ID NO: 734016 - DNA, 4570 bp, Homo sapiens; identical to SEQ ID NO: 318554

SEQ ID NO: 734017 - DNA, 2211 bp, Homo sapiens
  misc_feature (1874)..(1874): n is a, c, g, or t
cagggactcgtagacccagttggatcataaaaagcagaagctttgctttcctaacagacggaaacaggcaggtgtgcagttcaggagctgggccctcttggtctttcttgctttttgcagccatttaaggtgtgatgtttgcattcagtgagtgcatactccataagaccctgtcaaacaaatgccattcccctttccaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaaanaaaaaaaaaaaaaaaaaaaaaaaaatttgtgggggggctgcgggccctgagaaaaagtttttaaaaccttcggtgggggggcggggcgcccagtagtgtacttgtcagaccttggcgccataggctggtttccagaggaagatccgggcgcccatgagactcatgggtgcttggtgttccttcctccccagttaaataaaaagccgccgcgggggggaacccggagctgtttctggaaccaattcccagaagtagggaggttccgaggggcgccctcacgggaggcgtttatccaccaggggagttccagggagagtcccgattttaaaattagtcg

SEQ ID NO: 734018 - DNA, 1872 bp, Homo sapiens
cagggactcgtagacccagttggatcataaaaagcagaagctttgctttcctaacagacggaaacaggcaggtgtgcagttcaggagctgggccctcttggtctttcttgctttttgcagccatttaaggtgtgatgtttgcattcagtgagtgcatactccataagaccctgtcaaacaaatgccattcccctttccaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaa

SEQ ID NO: 734019 - DNA, 2571 bp, Homo sapiens
gactatatattcctgtttagcaagttctagagttgtcagaaatgaatgatggtaacatagattgaacctcaaacatggcatctgaagtaagacagtttattagtacatcactcacgggtgtactctcttcatttctgttgcttcagagttcactttgccataaacgtcacaacttgatacctcccatatttcattgtaactgcctccttctgtgagccccatgtgttttgtttcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtaccctgggtttagcttgtcatctgttctagaaatggtggctcagaggctgggtgcggtggctcaagcctgtaatcccagcactttgggaggctgaggcgggcggatcacgaggtcaggagatcgagaccacggtgaaaccccgtctctactaaaaatacaaaatatcagccgggcgcggtggtgggtgcctgtagtcccatctactcgggaggctgaggcatgagaatggcgtgaacccgggaggcggagcttgcagtgagttgcgatcactccactgcactccagcctgggcgagagagcaagactccatctcaaaaaaaaaaaaaaaaaaaaaaaaaagaaatggtgtctcagaaaatgtacagcaaactgcttctcacttcatttttttagcaaaggtcagattttctggatcataaacctgggacttggttcttttttggggggtttcttgttttaaatttctgccagatcagctgcctcctttacttcccttcaaacaacaatgtgctgcttattacataagctagcagggtgtcaggaaattccactgatgtgttttctcccacccttatattagtaatttttatacaacatggagacattgaaatattttcatcagatggggtagcttttgatccaaatatattcaaagacattatcgctgaaatgccagcttcatacaaatcatcttccaggtgtcactacactgcatttctatggagcgtgagaactaatttgacaaaatagaggttttgagggaaaaaccagtatttattttttaatctcctaagagtgttattaggtaatttttcctttgcatgtttagcacactgagttaagtaaactgtcttttgagtgccactatgagcaaagtgtaaaaagtcaagtcagtgagaaggggaaacacgcttggtcagcaggtatgggattctgttgcaggtgtgtgcgcccttcccggccaccccgtggcttccaaccctgtcaggctcacctcggccaccttggaaaaggcctgatgaggaagccgccagattcctacccaccgaaggtgagtcttgagtagatgtgagtgctcagggcacacatgcagacatgaggttttcaatacgagactgaataagaatgggatcctagaggcgctgcctgtgaaatgctgagtcagcctcactaggtcagcaggctctgagggagggtctctgtgatctggggccagagggaggccccacggtgcccccatggaagcccacctagatcctgttggcgcactcagtgccccctgcatgatatggtgcagcatagtgtgagctgtgatcccttcagtcacccagaccagccacatttctggggccccactgggtctgcagcccgagctggctcctgacaccagcccccaatgccagccccaccatggtttccaaatgccaccacctggctttaggtgagctgctttagcccactgttactcttaaaatatttttcaaaagttacatggagctctcagaattgaccattttgctccagccctgagctgaggaagccctgtccaccctgtggtttcagagaactggatccttaacccagagtacctcacggctccctgctgtctcttaaccctcttgctaccctggtgaattacagctagagttcattctaatagttcttccccaccgagtttttctgatgtacccacaagaattcttgaatattgaacttagtcaacaagagtccaaattataacagtgaacaagattggtgtcaaaaaaaataagtgattgaaaaatcattgctgcatatgcagtaggcaataaactgttttaactcccttgatccaaaaaacgcaaagggtggggctccaaggaggaggctgccattcccaataagctttacccctgctcgtccccaaaggtggaaccataagcgagaacggctttgtgtggtagccaaaagcacatcttcattttcgtaaaaaagaaaaatgcagctctattaaaaaaaaaaaaaaagcacagccttatttttgagagccccaaactagaaacaatccaaatatccatcaaccagtaaaaggataaacaatggtatatttgcacaatggaatgaaccattgatgtatacaacattgaggatgaatctctagataattattctgagtaaaagaagaaaagccagagtatatactctgtgatcccactt

SEQ ID NO: 734020 - DNA, 2788 bp, Homo sapiens
  misc_feature (41)..(42): n is a, c, g, or t
  misc_feature (49)..(51): n is a, c, g, or t
  misc_feature (53)..(53): n is a, c, g, or t
  misc_feature (55)..(55): n is a, c, g, or t
  misc_feature (2451)..(2451): n is a, c, g, or t
tggcgcctttactaagtacaccgctcttctcttacttgtgnngaacgcnnnananatcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaaanaaaaaaaaaaaaaaaaaaaaaaaaatttgtgggggggctgcgggccctgagaaaaagtttttaaaaccttcggtgggggggcggggcgcccagtagtgtacttgtcagaccttggcgccataggctggtttccagaggaagatccgggcgcccatgagactcatgggtgcttggtgttccttcctccccagttaaataaaaagccgccgcgggggggaacccggagctgtttctggaaccaattcccagaagtagggaggttccgaggggcgccctcacgggaggcgtttatccaccaggggagttccagggagagtcccgattttaaaattagtcg

SEQ ID NO: 734021 - DNA, 2449 bp, Homo sapiens
  misc_feature (41)..(42): n is a, c, g, or t
  misc_feature (49)..(51): n is a, c, g, or t
  misc_feature (53)..(53): n is a, c, g, or t
  misc_feature (55)..(55): n is a, c, g, or t
tggcgcctttactaagtacaccgctcttctcttacttgtgnngaacgcnnnananatcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaa

SEQ ID NO: 734022 - DNA, 5147 bp, Homo sapiens; identical to SEQ ID NO: 318551
  misc_feature (41)..(42): n is a, c, g, or t
  misc_feature (49)..(51): n is a, c, g, or t
  misc_feature (53)..(53): n is a, c, g, or t
  misc_feature (55)..(55): n is a, c, g, or t

SEQ ID NO: 734023 - DNA, 949 bp, Homo sapiens
  misc_feature (41)..(42): n is a, c, g, or t
  misc_feature (49)..(51): n is a, c, g, or t
  misc_feature (53)..(53): n is a, c, g, or t
  misc_feature (55)..(55): n is a, c, g, or t
tggcgcctttactaagtacaccgctcttctcttacttgtgnngaacgcnnnananatcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggtaagaaccattcccagaacaaggatacaagaagacttgtatcctcggctaggcaaagaagagagaacttggaggaactgtacagccagatgaaagtactagaactcaggaaggaagagtcctatctgcccatcctgaacaagccccgtgagctagggtggctttcttgaat

SEQ ID NO: 734024 - DNA, 3053 bp, Homo sapiens
  misc_feature (2716)..(2716): n is a, c, g, or t
gattcattttcagtaactaataagcagaacattttgctcaaaatgaacaagttattgtccttggcagaagtgtctgaaagatcctaattcacttattgtttcacttgcagtggatattaactggccatctttagctataatacacatctgtatgtacattttaaatcaccagtgagtcatttgaaatgtatgcttccatacaaatgcaagtagacagtaaaaaagctgataacttcagcatctaattggtcaatcttcgagaacctagttaacacatcactttgcattaggcactgcaaatatttcttaaattccaacaccacaggaaccaaagagcacagagatatttttctcacctgtgtcagtgaccctcaaataacgcaaatctgttctaattttcatttcgagtttttattaacgtgatcccaactccaatgccagttttgcctgttttgcccagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaaanaaaaaaaaaaaaaaaaaaaaaaaaatttgtgggggggctgcgggccctgagaaaaagtttttaaaaccttcggtgggggggcggggcgcccagtagtgtacttgtcagaccttggcgccataggctggtttccagaggaagatccgggcgcccatgagactcatgggtgcttggtgttccttcctccccagttaaataaaaagccgccgcgggggggaacccggagctgtttctggaaccaattcccagaagtagggaggttccgaggggcgccctcacgggaggcgtttatccaccaggggagttccagggagagtcccgattttaaaattagtcg

SEQ ID NO: 734025 - DNA, 2714 bp, Homo sapiens
gattcattttcagtaactaataagcagaacattttgctcaaaatgaacaagttattgtccttggcagaagtgtctgaaagatcctaattcacttattgtttcacttgcagtggatattaactggccatctttagctataatacacatctgtatgtacattttaaatcaccagtgagtcatttgaaatgtatgcttccatacaaatgcaagtagacagtaaaaaagctgataacttcagcatctaattggtcaatcttcgagaacctagttaacacatcactttgcattaggcactgcaaatatttcttaaattccaacaccacaggaaccaaagagcacagagatatttttctcacctgtgtcagtgaccctcaaataacgcaaatctgttctaattttcatttcgagtttttattaacgtgatcccaactccaatgccagttttgcctgttttgcccagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaa

SEQ ID NO: 734026 - DNA, 5412 bp, Homo sapiens; identical to SEQ ID NO: 318552

SEQ ID NO: 734027 - DNA, 1214 bp, Homo sapiens
gattcattttcagtaactaataagcagaacattttgctcaaaatgaacaagttattgtccttggcagaagtgtctgaaagatcctaattcacttattgtttcacttgcagtggatattaactggccatctttagctataatacacatctgtatgtacattttaaatcaccagtgagtcatttgaaatgtatgcttccatacaaatgcaagtagacagtaaaaaagctgataacttcagcatctaattggtcaatcttcgagaacctagttaacacatcactttgcattaggcactgcaaatatttcttaaattccaacaccacaggaaccaaagagcacagagatatttttctcacctgtgtcagtgaccctcaaataacgcaaatctgttctaattttcatttcgagtttttattaacgtgatcccaactccaatgccagttttgcctgttttgcccagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggtaagaaccattcccagaacaaggatacaagaagacttgtatcctcggctaggcaaagaagagagaacttggaggaactgtacagccagatgaaagtactagaactcaggaaggaagagtcctatctgcccatcctgaacaagccccgtgagctagggtggctttcttgaat

SEQ ID NO: 734028 - DNA, 1195 bp, Homo sapiens
atgacatggcataagtgaggggtacgactgcagggagagagggcatcatgggaggggagcaacccccacagagcggcagggggttgtcaggaaggctcctggggaccctgcatctgttgaggtctgaagggggcgagggaaacatgcattctgaagccgagatagctggctgtgcgaagatctagaggagtgtggactggcctgggctcagattctagagtgcggactgggccaacaggaggggacacaggacacggtgctcgtgctggtcctggggaagagggaaatggagtcagtcactgcccgggcctctggcttgagcaacctggggagttcagcaggttcagtgtgggggccctgtaaatgttcagtttcatagattgatgtattgaagatttatggattcactttatggaactagaaattatagttcaagatttttgctgttcactttttaaattaactttaattaactttgttatgagacaccagaactctagctagagccccctgtgatcactactaagggtctgaaaagagtgacattttgcccaggaaaccagaagcaatgcttttccagtaacaccaacaagtaagtcaagactgtcatctgttggctgtcttgcttaggctaagacacatccctgataggccttgttagtgggggatggggtccagaaaccaagaaggtgtgaaagacattctttccctggagtaggagctgctgctgcagtgatccacagccagctgagggtccaggtgggaggcagggccgaggagagcccaggtaactgcatcacggcgatcaccagcagccggaaaggactgttgcacacttacctgatgtgaagtacaccctgatccttgctgatgggaagacaaatgaatcaagatccctgtcctctaaaaattcactgtccagttgaaatcacaggtagacctcctctaagtctgagcatttagagtccttcccagacagccgctgaccatagctactgtaagaaaccaacctgatggtttgatttttttccttcctttccctacccttgaggaggctcttaactgtattaaacaaaatggcagcaggtcatagaaaagaagatgttttcatagagaaaatagcttcctcccaggaaaagggtttcccccacaaaggctgtgtttttaagtccccaacataacaaagcaaaaccca

SEQ ID NO: 734029 - DNA, 5958 bp, Homo sapiens; identical to SEQ ID NO: 318528

SEQ ID NO: 734030 - DNA, 3599 bp, Homo sapiens
  misc_feature (3262)..(3262): n is a, c, g, or t
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcaggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaaanaaaaaaaaaaaaaaaaaaaaaaaaatttgtgggggggctgcgggccctgagaaaaagtttttaaaaccttcggtgggggggcggggcgcccagtagtgtacttgtcagaccttggcgccataggctggtttccagaggaagatccgggcgcccatgagactcatgggtgcttggtgttccttcctccccagttaaataaaaagccgccgcgggggggaacccggagctgtttctggaaccaattcccagaagtagggaggttccgaggggcgccctcacgggaggcgtttatccaccaggggagttccagggagagtcccgattttaaaattagtcg

SEQ ID NO: 734031 - DNA, 3260 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcaggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaa

SEQ ID NO: 734032 - DNA, 1760 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcaggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggtaagaaccattcccagaacaaggatacaagaagacttgtatcctcggctaggcaaagaagagagaacttggaggaactgtacagccagatgaaagtactagaactcaggaaggaagagtcctatctgcccatcctgaacaagccccgtgagctagggtggctttcttgaat

SEQ ID NO: 734033 - DNA, 1077 bp, Homo sapiens; identical to SEQ ID NO: 318541

SEQ ID NO: 734034 - DNA, 1389 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcttggggatgtcagttaaattcagtctcagctccaaaggtgattcagagatgaatcagtaactgctttaatgatattaacatctcagaatcaaaaagaaccaagtattgtagatggcttaaaggagaaaagtatatcccttcatataccttgtttattctttatcaaaacattccagaatcctaactctgaaaacattaaccaattgctgtcactgacaaatgggacctgaggcctgtaaatacaaggatagagtcctat

SEQ ID NO: 734035 - DNA, 3316 bp, Homo sapiens
cagggactcgtagacccagttggatcataaaaagcagaagctttgctttcctaacagacggaaacaggcaggtgtgcagttcaggagctgggccctcttggtctttcttgctttttgcagccatttaaggtgtgatgtttgcattcagtgagtgcatactccataagaccctgtcaaacaaatgccattcccctttccaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtaccctgggtttagcttgtcatctgttctagaaatggtggctcagaggctgggtgcggtggctcaagcctgtaatcccagcactttgggaggctgaggcgggcggatcacgaggtcaggagatcgagaccacggtgaaaccccgtctctactaaaaatacaaaatatcagccgggcgcggtggtgggtgcctgtagtcccatctactcgggaggctgaggcatgagaatggcgtgaacccgggaggcggagcttgcagtgagttgcgatcactccactgcactccagcctgggcgagagagcaagactccatctcaaaaaaaaaaaaaaaaaaaaaaaaaagaaatggtgtctcagaaaatgtacagcaaactgcttctcacttcatttttttagcaaaggtcagattttctggatcataaacctgggacttggttcttttttggggggtttcttgttttaaatttctgccagatcagctgcctcctttacttcccttcaaacaacaatgtgctgcttattacataagctagcagggtgtcaggaaattccactgatgtgttttctcccacccttatattagtaatttttatacaacatggagacattgaaatattttcatcagatggggtagcttttgatccaaatatattcaaagacattatcgctgaaatgccagcttcatacaaatcatcttccaggtgtcactacactgcatttctatggagcgtgagaactaatttgacaaaatagaggttttgagggaaaaaccagtatttattttttaatctcctaagagtgttattaggtaatttttcctttgcatgtttagcacactgagttaagtaaactgtcttttgagtgccactatgagcaaagtgtaaaaagtcaagtcagtgagaaggggaaacacgcttggtcagcaggtatgggattctgttgcaggtgtgtgcgcccttcccggccaccccgtggcttccaaccctgtcaggctcacctcggccaccttggaaaaggcctgatgaggaagccgccagattcctacccaccgaaggtgagtcttgagtagatgtgagtgctcagggcacacatgcagacatgaggttttcaatacgagactgaataagaatgggatcctagaggcgctgcctgtgaaatgctgagtcagcctcactaggtcagcaggctctgagggagggtctctgtgatctggggccagagggaggccccacggtgcccccatggaagcccacctagatcctgttggcgcactcagtgccccctgcatgatatggtgcagcatagtgtgagctgtgatcccttcagtcacccagaccagccacatttctggggccccactgggtctgcagcccgagctggctcctgacaccagcccccaatgccagccccaccatggtttccaaatgccaccacctggctttaggtgagctgctttagcccactgttactcttaaaatatttttcaaaagttacatggagctctcagaattgaccattttgctccagccctgagctgaggaagccctgtccaccctgtggtttcagagaactggatccttaacccagagtacctcacggctccctgctgtctcttaaccctcttgctaccctggtgaattacagctagagttcattctaatagttcttccccaccgagtttttctgatgtacccacaagaattcttgaatattgaacttagtcaacaagagtccaaattataacagtgaacaagattggtgtcaaaaaaaataagtgattgaaaaatcattgctgcatatgcagtaggcaataaactgttttaactcccttgatccaaaaaacgcaaagggtggggctccaaggaggaggctgccattcccaataagctttacccctgctcgtccccaaaggtggaaccataagcgagaacggctttgtgtggtagccaaaagcacatcttcattttcgtaaaaaagaaaaatgcagctctattaaaaaaaaaaaaaaagcacagccttatttttgagagccccaaactagaaacaatccaaatatccatcaaccagtaaaaggataaacaatggtatatttgcacaatggaatgaaccattgatgtatacaacattgaggatgaatctctagataattattctgagtaaaagaagaaaagccagagtatatactctgtgatcccactt

SEQ ID NO: 734036 - DNA, 4789 bp, Homo sapiens; identical to SEQ ID NO: 318531

SEQ ID NO: 734037 - DNA, 1006 bp, Homo sapiens
tagaggatccccggtgtttatcgatgccacagatcaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaataccgctgcctccaccctgttcatacatatataaaatcaaggcaggccatgagcaagcatggctcactgctccctggcctggccatggctcaggggctcattaaacaagtactcgtgtgtctgccacacaccagccactctcctgggtcctggagagacattaagcaagaatgacatggcataagtgaggggtacgactgcagggagagagggcatcatgggaggggagcaacccccacagag

SEQ ID NO: 734038 - DNA, 2115 bp, Homo sapiens
cagggactcgtagacccagttggatcataaaaagcagaagctttgctttcctaacagacggaaacaggcaggtgtgcagttcaggagctgggccctcttggtctttcttgctttttgcagccatttaaggtgtgatgtttgcattcagtgagtgcatactccataagaccctgtcaaacaaatgccattcccctttccaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaataccgctgcctccaccctgttcatacatatataaaatcaaggcaggccatgagcaagcatggctcactgctccctggcctggccatggctcaggggctcattaaacaagtactcgtgtgtctgccacacaccagccactctcctgggtcctggagagacattaagcaagaatgacatggcataagtgaggggtacgactgcagggagagagggcatcatgggaggggagcaacccccacagag

SEQ ID NO: 734039 - DNA, 2692 bp, Homo sapiens
  misc_feature (41)..(42): n is a, c, g, or t
  misc_feature (49)..(51): n is a, c, g, or t
  misc_feature (53)..(53): n is a, c, g, or t
  misc_feature (55)..(55): n is a, c, g, or t
tggcgcctttactaagtacaccgctcttctcttacttgtgnngaacgcnnnananatcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaataccgctgcctccaccctgttcatacatatataaaatcaaggcaggccatgagcaagcatggctcactgctccctggcctggccatggctcaggggctcattaaacaagtactcgtgtgtctgccacacaccagccactctcctgggtcctggagagacattaagcaagaatgacatggcataagtgaggggtacgactgcagggagagagggcatcatgggaggggagcaacccccacagag

SEQ ID NO: 734040 - DNA, 3893 bp, Homo sapiens
  misc_feature (41)..(42): n is a, c, g, or t
  misc_feature (49)..(51): n is a, c, g, or t
  misc_feature (53)..(53): n is a, c, g, or t
  misc_feature (55)..(55): n is a, c, g, or t
tggcgcctttactaagtacaccgctcttctcttacttgtgnngaacgcnnnananatcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtaccctgggtttagcttgtcatctgttctagaaatggtggctcagaggctgggtgcggtggctcaagcctgtaatcccagcactttgggaggctgaggcgggcggatcacgaggtcaggagatcgagaccacggtgaaaccccgtctctactaaaaatacaaaatatcagccgggcgcggtggtgggtgcctgtagtcccatctactcgggaggctgaggcatgagaatggcgtgaacccgggaggcggagcttgcagtgagttgcgatcactccactgcactccagcctgggcgagagagcaagactccatctcaaaaaaaaaaaaaaaaaaaaaaaaaagaaatggtgtctcagaaaatgtacagcaaactgcttctcacttcatttttttagcaaaggtcagattttctggatcataaacctgggacttggttcttttttggggggtttcttgttttaaatttctgccagatcagctgcctcctttacttcccttcaaacaacaatgtgctgcttattacataagctagcagggtgtcaggaaattccactgatgtgttttctcccacccttatattagtaatttttatacaacatggagacattgaaatattttcatcagatggggtagcttttgatccaaatatattcaaagacattatcgctgaaatgccagcttcatacaaatcatcttccaggtgtcactacactgcatttctatggagcgtgagaactaatttgacaaaatagaggttttgagggaaaaaccagtatttattttttaatctcctaagagtgttattaggtaatttttcctttgcatgtttagcacactgagttaagtaaactgtcttttgagtgccactatgagcaaagtgtaaaaagtcaagtcagtgagaaggggaaacacgcttggtcagcaggtatgggattctgttgcaggtgtgtgcgcccttcccggccaccccgtggcttccaaccctgtcaggctcacctcggccaccttggaaaaggcctgatgaggaagccgccagattcctacccaccgaaggtgagtcttgagtagatgtgagtgctcagggcacacatgcagacatgaggttttcaatacgagactgaataagaatgggatcctagaggcgctgcctgtgaaatgctgagtcagcctcactaggtcagcaggctctgagggagggtctctgtgatctggggccagagggaggccccacggtgcccccatggaagcccacctagatcctgttggcgcactcagtgccccctgcatgatatggtgcagcatagtgtgagctgtgatcccttcagtcacccagaccagccacatttctggggccccactgggtctgcagcccgagctggctcctgacaccagcccccaatgccagccccaccatggtttccaaatgccaccacctggctttaggtgagctgctttagcccactgttactcttaaaatatttttcaaaagttacatggagctctcagaattgaccattttgctccagccctgagctgaggaagccctgtccaccctgtggtttcagagaactggatccttaacccagagtacctcacggctccctgctgtctcttaaccctcttgctaccctggtgaattacagctagagttcattctaatagttcttccccaccgagtttttctgatgtacccacaagaattcttgaatattgaacttagtcaacaagagtccaaattataacagtgaacaagattggtgtcaaaaaaaataagtgattgaaaaatcattgctgcatatgcagtaggcaataaactgttttaactcccttgatccaaaaaacgcaaagggtggggctccaaggaggaggctgccattcccaataagctttacccctgctcgtccccaaaggtggaaccataagcgagaacggctttgtgtggtagccaaaagcacatcttcattttcgtaaaaaagaaaaatgcagctctattaaaaaaaaaaaaaaagcacagccttatttttgagagccccaaactagaaacaatccaaatatccatcaaccagtaaaaggataaacaatggtatatttgcacaatggaatgaaccattgatgtatacaacattgaggatgaatctctagataattattctgagtaaaagaagaaaagccagagtatatactctgtgatcccactt

SEQ ID NO: 734041 - DNA, 2957 bp, Homo sapiens
gattcattttcagtaactaataagcagaacattttgctcaaaatgaacaagttattgtccttggcagaagtgtctgaaagatcctaattcacttattgtttcacttgcagtggatattaactggccatctttagctataatacacatctgtatgtacattttaaatcaccagtgagtcatttgaaatgtatgcttccatacaaatgcaagtagacagtaaaaaagctgataacttcagcatctaattggtcaatcttcgagaacctagttaacacatcactttgcattaggcactgcaaatatttcttaaattccaacaccacaggaaccaaagagcacagagatatttttctcacctgtgtcagtgaccctcaaataacgcaaatctgttctaattttcatttcgagtttttattaacgtgatcccaactccaatgccagttttgcctgttttgcccagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaataccgctgcctccaccctgttcatacatatataaaatcaaggcaggccatgagcaagcatggctcactgctccctggcctggccatggctcaggggctcattaaacaagtactcgtgtgtctgccacacaccagccactctcctgggtcctggagagacattaagcaagaatgacatggcataagtgaggggtacgactgcagggagagagggcatcatgggaggggagcaacccccacagag

SEQ ID NO: 734042 - DNA, 4158 bp, Homo sapiens
gattcattttcagtaactaataagcagaacattttgctcaaaatgaacaagttattgtccttggcagaagtgtctgaaagatcctaattcacttattgtttcacttgcagtggatattaactggccatctttagctataatacacatctgtatgtacattttaaatcaccagtgagtcatttgaaatgtatgcttccatacaaatgcaagtagacagtaaaaaagctgataacttcagcatctaattggtcaatcttcgagaacctagttaacacatcactttgcattaggcactgcaaatatttcttaaattccaacaccacaggaaccaaagagcacagagatatttttctcacctgtgtcagtgaccctcaaataacgcaaatctgttctaattttcatttcgagtttttattaacgtgatcccaactccaatgccagttttgcctgttttgcccagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtaccctgggtttagcttgtcatctgttctagaaatggtggctcagaggctgggtgcggtggctcaagcctgtaatcccagcactttgggaggctgaggcgggcggatcacgaggtcaggagatcgagaccacggtgaaaccccgtctctactaaaaatacaaaatatcagccgggcgcggtggtgggtgcctgtagtcccatctactcgggaggctgaggcatgagaatggcgtgaacccgggaggcggagcttgcagtgagttgcgatcactccactgcactccagcctgggcgagagagcaagactccatctcaaaaaaaaaaaaaaaaaaaaaaaaaagaaatggtgtctcagaaaatgtacagcaaactgcttctcacttcatttttttagcaaaggtcagattttctggatcataaacctgggacttggttcttttttggggggtttcttgttttaaatttctgccagatcagctgcctcctttacttcccttcaaacaacaatgtgctgcttattacataagctagcagggtgtcaggaaattccactgatgtgttttctcccacccttatattagtaatttttatacaacatggagacattgaaatattttcatcagatggggtagcttttgatccaaatatattcaaagacattatcgctgaaatgccagcttcatacaaatcatcttccaggtgtcactacactgcatttctatggagcgtgagaactaatttgacaaaatagaggttttgagggaaaaaccagtatttattttttaatctcctaagagtgttattaggtaatttttcctttgcatgtttagcacactgagttaagtaaactgtcttttgagtgccactatgagcaaagtgtaaaaagtcaagtcagtgagaaggggaaacacgcttggtcagcaggtatgggattctgttgcaggtgtgtgcgcccttcccggccaccccgtggcttccaaccctgtcaggctcacctcggccaccttggaaaaggcctgatgaggaagccgccagattcctacccaccgaaggtgagtcttgagtagatgtgagtgctcagggcacacatgcagacatgaggttttcaatacgagactgaataagaatgggatcctagaggcgctgcctgtgaaatgctgagtcagcctcactaggtcagcaggctctgagggagggtctctgtgatctggggccagagggaggccccacggtgcccccatggaagcccacctagatcctgttggcgcactcagtgccccctgcatgatatggtgcagcatagtgtgagctgtgatcccttcagtcacccagaccagccacatttctggggccccactgggtctgcagcccgagctggctcctgacaccagcccccaatgccagccccaccatggtttccaaatgccaccacctggctttaggtgagctgctttagcccactgttactcttaaaatatttttcaaaagttacatggagctctcagaattgaccattttgctccagccctgagctgaggaagccctgtccaccctgtggtttcagagaactggatccttaacccagagtacctcacggctccctgctgtctcttaaccctcttgctaccctggtgaattacagctagagttcattctaatagttcttccccaccgagtttttctgatgtacccacaagaattcttgaatattgaacttagtcaacaagagtccaaattataacagtgaacaagattggtgtcaaaaaaaataagtgattgaaaaatcattgctgcatatgcagtaggcaataaactgttttaactcccttgatccaaaaaacgcaaagggtggggctccaaggaggaggctgccattcccaataagctttacccctgctcgtccccaaaggtggaaccataagcgagaacggctttgtgtggtagccaaaagcacatcttcattttcgtaaaaaagaaaaatgcagctctattaaaaaaaaaaaaaaagcacagccttatttttgagagccccaaactagaaacaatccaaatatccatcaaccagtaaaaggataaacaatggtatatttgcacaatggaatgaaccattgatgtatacaacattgaggatgaatctctagataattattctgagtaaaagaagaaaagccagagtatatactctgtgatcccactt

SEQ ID NO: 734043 - DNA, 1770 bp, Homo sapiens
atccctgcccgatcttctctgaggctccttgctctctgctttgactgagtggctgagtttgccagttccttagcctgcgacacttttcttaactaaggtcatttctatagtgaactgctgaatgggtatgaatgtcatcactgtatcaaagtactttgtaaaggccgacatctgtgtggtagggtgacaaggtgtgaagtttaatgccttttaaaaatcttactggaaagacacccacctcttagtaaaggtgacagtcacggcagcagtgggagtcattgcaacagcttttgcatatggaatgatgtgtgcaggtgctgtgtggtgcattttatgcccatgatgtcatcccctccttatacaactctgaagaaggtggtatgattcttttctcacatacctaggacctgaggctcagggaagttaagtaatttgcctaatgtgatctcgctaagatttacacacacacaggtctgcctgtcccccaagaagctcttagtagcagctgtgcttgaactcgtggccatttctcctcggatgacctttagaaatggtttactggtgcggtgctgttttctctgagttcttattgggcaattcaggggcaagtctaaatgatgcctcttttcgagggaaaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaataccgctgcctccaccctgttcatacatatataaaatcaaggcaggccatgagcaagcatggctcactgctccctggcctggccatggctcaggggctcattaaacaagtactcgtgtgtctgccacacaccagccactctcctgggtcctggagagacattaagcaagaatgacatggcataagtgaggggtacgactgcagggagagagggcatcatgggaggggagcaacccccacagag

SEQ ID NO: 734044 - DNA, 3588 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaataccgctgcctccaccctgttcatacatatataaaatcaaggcaggccatgagcaagcatggctcactgctccctggcctggccatggctcaggggctcattaaacaagtactcgtgtgtctgccacacaccagccactctcctgggtcctggagagacattaagcaagaatgacatggcataagtgaggggtacgactgcagggagagagggcatcatgggaggggagcaacccccacagag

SEQ ID NO: 734045 - DNA, 3503 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcaggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttcccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaataccgctgcctccaccctgttcatacatatataaaatcaaggcaggccatgagcaagcatggctcactgctccctggcctggccatggctcaggggctcattaaacaagtactcgtgtgtctgccacacaccagccactctcctgggtcctggagagacattaagcaagaatgacatggcataagtgaggggtacgactgcagggagagagggcatcatgggaggggagcaacccccacagag

SEQ ID NO: 734046 - DNA, 4704 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcaggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtaccctgggtttagcttgtcatctgttctagaaatggtggctcagaggctgggtgcggtggctcaagcctgtaatcccagcactttgggaggctgaggcgggcggatcacgaggtcaggagatcgagaccacggtgaaaccccgtctctactaaaaatacaaaatatcagccgggcgcggtggtgggtgcctgtagtcccatctactcgggaggctgaggcatgagaatggcgtgaacccgggaggcggagcttgcagtgagttgcgatcactccactgcactccagcctgggcgagagagcaagactccatctcaaaaaaaaaaaaaaaaaaaaaaaaaagaaatggtgtctcagaaaatgtacagcaaactgcttctcacttcatttttttagcaaaggtcagattttctggatcataaacctgggacttggttcttttttggggggtttcttgttttaaatttctgccagatcagctgcctcctttacttcccttcaaacaacaatgtgctgcttattacataagctagcagggtgtcaggaaattccactgatgtgttttctcccacccttatattagtaatttttatacaacatggagacattgaaatattttcatcagatggggtagcttttgatccaaatatattcaaagacattatcgctgaaatgccagcttcatacaaatcatcttccaggtgtcactacactgcatttctatggagcgtgagaactaatttgacaaaatagaggttttgagggaaaaaccagtatttattttttaatctcctaagagtgttattaggtaatttttcctttgcatgtttagcacactgagttaagtaaactgtcttttgagtgccactatgagcaaagtgtaaaaagtcaagtcagtgagaaggggaaacacgcttggtcagcaggtatgggattctgttgcaggtgtgtgcgcccttcccggccaccccgtggcttccaaccctgtcaggctcacctcggccaccttggaaaaggcctgatgaggaagccgccagattcctacccaccgaaggtgagtcttgagtagatgtgagtgctcagggcacacatgcagacatgaggttttcaatacgagactgaataagaatgggatcctagaggcgctgcctgtgaaatgctgagtcagcctcactaggtcagcaggctctgagggagggtctctgtgatctggggccagagggaggccccacggtgcccccatggaagcccacctagatcctgttggcgcactcagtgccccctgcatgatatggtgcagcatagtgtgagctgtgatcccttcagtcacccagaccagccacatttctggggccccactgggtctgcagcccgagctggctcctgacaccagcccccaatgccagccccaccatggtttccaaatgccaccacctggctttaggtgagctgctttagcccactgttactcttaaaatatttttcaaaagttacatggagctctcagaattgaccattttgctccagccctgagctgaggaagccctgtccaccctgtggtttcagagaactggatccttaacccagagtacctcacggctccctgctgtctcttaaccctcttgctaccctggtgaattacagctagagttcattctaatagttcttccccaccgagtttttctgatgtacccacaagaattcttgaatattgaacttagtcaacaagagtccaaattataacagtgaacaagattggtgtcaaaaaaaataagtgattgaaaaatcattgctgcatatgcagtaggcaataaactgttttaactcccttgatccaaaaaacgcaaagggtggggctccaaggaggaggctgccattcccaataagctttacccctgctcgtccccaaaggtggaaccataagcgagaacggctttgtgtggtagccaaaagcacatcttcattttcgtaaaaaagaaaaatgcagctctattaaaaaaaaaaaaaaagcacagccttatttttgagagccccaaactagaaacaatccaaatatccatcaaccagtaaaaggataaacaatggtatatttgcacaatggaatgaaccattgatgtatacaacattgaggatgaatctctagataattattctgagtaaaagaagaaaagccagagtatatactctgtgatcccactt

SEQ ID NO: 734047 - DNA, 267 bp, Homo sapiens; identical to SEQ ID NO: 318544

SEQ ID NO: 734048 - DNA, 889 bp, Homo sapiens
ggcttcaatccagcactttgctcgggtcacggcctcctcctggctcccaggaccccaccataggcagaggcaggccttcctacaccctactccctgtgcctccaggctcgactagtccctagcactcgacgactgagtctctgagatcacttcaccgtggtctccgcctcacccttggcgctggaccagtgagaggagagggctggggcgctccgctgagccactcctgcgcccccctggccttgtctacctcttgccccccgaaggtttaggtgtcgagctcaccccagcatcctacaacctcctggtggccttgccgcccccacaaccccgaggtataaagccaggtacacgaggcaggggacgcaccaaggatggagatgttccaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagtccatcccgactcccggggccctcggacaccccgatcctcccacaataaaggcttctcaatccgca

SEQ ID NO: 734049 - DNA, 538 bp, Homo sapiens; identical to SEQ ID NO: 440716

SEQ ID NO: 734050 - DNA, 951 bp, Homo sapiens
  misc_feature (844)..(844): n is a, c, g, or t
  misc_feature (852)..(852): n is a, c, g, or t
  misc_feature (856)..(856): n is a, c, g, or t
  misc_feature (863)..(863): n is a, c, g, or t
  misc_feature (866)..(866): n is a, c, g, or t
  misc_feature (872)..(872): n is a, c, g, or t
ggcttcaatccagcactttgctcgggtcacggcctcctcctggctcccaggaccccaccataggcagaggcaggccttcctacaccctactccctgtgcctccaggctcgactagtccctagcactcgacgactgagtctctgagatcacttcaccgtggtctccgcctcacccttggcgctggaccagtgagaggagagggctggggcgctccgctgagccactcctgcgcccccctggccttgtctacctcttgccccccgaaggtttaggtgtcgagctcaccccagcatcctacaacctcctggtggccttgccgcccccacaaccccgaggtataaagccaggtacacgaggcaggggacgcaccaaggatggagatgttccaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagtccatcccgactcccgggctngaaccganctcnaataagnttncatcgnaaaaaaaaaaccgaggaataatcgtgcgacaaggaaaaaggaagggaataaatcacacaactttgaaagggaagcgacc

SEQ ID NO: 734051 - DNA, 491 bp, Homo sapiens
  misc_feature (408)..(409): n is a, c, g, or t
  misc_feature (429)..(429): n is a, c, g, or t
  misc_feature (470)..(470): n is a, c, g, or t
  misc_feature (482)..(482): n is a, c, g, or t
gggagaggagggggaggggaggggagaggaattgaggagcagaacagaataacacagaaagaaccaaccagagctggaccaaaaatcgaggccaggatgttgtagagtcttgggttcaaattctgcctcctcctgggaagtcccctgagcctgctacaaggtcttggcttgcaccctattgcctctggcagatcctccaaccagcaccaatgaagcacctaccccatgcagggtccttcagaaacaaagagtgagatagcttccagtctcaggtggggaatatttagacttgtgaacaggggcaaagaaggagaggatgttcctgttccttccccaccaccaagaccttatttcccgcatttcggacctgaggccacgggttttgcccagggtttaaggggccacggnnaaggaaggttggccgaacgnggtttgaacccaacgccttgggcccaacgttggggacgacntggccccaacgngttgttccg

SEQ ID NO: 734052 - DNA, 1759 bp, Homo sapiens
gggagaggagggggaggggaggggagaggaattgaggagcagaacagaataacacagaaagaaccaaccagagctggaccaaaaatcgaggccaggatgttgtagagtcttgggttcaaattctgcctcctcctgggaagtcccctgagcctgctacaaggtcttggcttgcaccctattgcctctggcagatcctccaaccagcaccaatgaagcacctaccccatgcagggtccttcagaaacaaagagtgagatagcttccagtctcaggtggggaatatttagacttgtgaacaggggcaaagaaggagagaaacaaccaggaagtaacctccaatttgcagatggggaaaattaagtttcatcaggaggaaatgactttgcctcaggcttctcttgggatcccagatttctagaggatggggggaatgtccctgctttgggcatgtttttaagagcactggaacagccagagctgctgcccacagtctgaagtcaggaggggaactccatgtcagataaaagctttggaatccagatggagtaaggtttcattttctctgcctgcatttggtttcctaacatcacaatgtgagccttggctagcagccagcttagctttggaaaagagtgaatgatggggaaaaaaaaaaaaaaagactgtgccaggaagggaggggaggagaggggctacactaggctggaggggatatgggcctggctttagaggattatgctaggaaaaggggtgccagaggttgaaagctgataggaacaagccctgtggatcaagaggcccatcagtgagcctgcagggtctatgaactccttacatgcaaaattacatgtgtctgtctgtgtaggtctctacagattggtggaagtgttcacagctttcatgagattattatttttttttttttaagaaaggcacactgccgcatgcaacacctcatttggatgtgtctggagtcttggaagtttgactaccctacattctcctacaaatggaccttgagagcttgtttggaggttctagcaggggagcgcactacttcgtatacccttgaccaaagaacagtcctcctctattggggaaggttgtcctcttctgaaactaccttttgcaaaaattatagcagtgagaaaattatgacagtgaaagaaatctgacctaattgactccatcttgcttctaacctcccagctgcccttgttcattcctgggcatagggagcactaactttgggaggatttagtttatagtttaactttgaaacaaagatgataacagcccctccctgagaccaacccactccttgcctggggaccagaaagcctttgtaaaactaacacattggccacaagattagaaatgacggctcaggagtcatgcagccaaaggcctcgagatcatgaacctccccaattgctcctgtagataatattattattgtaaaacctaacatgggtgtttgaggtatttttcagaccctgccttctgatggatcagctggcaccacccagaccagtaaactggctcatctggtcttctggcccccacccaggaaccaactcagtgcaagaggatagcttcaactccttatgatttcatccccgacccaaccaatcagcattcccgcttcccgagccccctgcccgccaaactacctttaaaaaaccctagcctccaaattttcagggaggctgatttgagtaataataaaacccctgtctcctgtttaaaaaactctact

SEQ ID NO: 734053 - DNA, 929 bp, Homo sapiens; identical to SEQ ID NO: 429072

SEQ ID NO: 734054 - DNA, 582 bp, Homo sapiens
tctcctcctctgtgcgacatcctcctcctccttctttgcctcaggcttctcttgggatcccagatttctagaggatggggggaatgtccctgctttgggcatgtttttaagagcactggaacagccagagctgctgcccacagtctgaagtcaggaggggaactccatgtcagataaaagctttggaatccagatggagtaaggtttcattttctctgcctgcatttggtttcctaacatcacaatgtgagccttggctagcagccagcttagctttggaaaagagtgaatgatggggaaaaaaaaaaaaaaagactgtgccaggaagggaggggaggagaggggctacactaggctggaggggatatgggcctggcttttgggggtttttcctacagggcctgggttggcccctttttgcctttggcggttcctccacccggccccattgaggcccttcccccttgcggggtccttcagaaacaaagagggagatggcttccggtctcagggggggattttttagccttgggaccgggggcaaggagggggggaaccacccgggaggtaccctccatttgg

SEQ ID NO: 734055 - DNA, 1412 bp, Homo sapiens
tctcctcctctgtgcgacatcctcctcctccttctttgcctcaggcttctcttgggatcccagatttctagaggatggggggaatgtccctgctttgggcatgtttttaagagcactggaacagccagagctgctgcccacagtctgaagtcaggaggggaactccatgtcagataaaagctttggaatccagatggagtaaggtttcattttctctgcctgcatttggtttcctaacatcacaatgtgagccttggctagcagccagcttagctttggaaaagagtgaatgatggggaaaaaaaaaaaaaaagactgtgccaggaagggaggggaggagaggggctacactaggctggaggggatatgggcctggctttagaggattatgctaggaaaaggggtgccagaggttgaaagctgataggaacaagccctgtggatcaagaggcccatcagtgagcctgcagggtctatgaactccttacatgcaaaattacatgtgtctgtctgtgtaggtctctacagattggtggaagtgttcacagctttcatgagattattatttttttttttttaagaaaggcacactgccgcatgcaacacctcatttggatgtgtctggagtcttggaagtttgactaccctacattctcctacaaatggaccttgagagcttgtttggaggttctagcaggggagcgcactacttcgtatacccttgaccaaagaacagtcctcctctattggggaaggttgtcctcttctgaaactaccttttgcaaaaattatagcagtgagaaaattatgacagtgaaagaaatctgacctaattgactccatcttgcttctaacctcccagctgcccttgttcattcctgggcatagggagcactaactttgggaggatttagtttatagtttaactttgaaacaaagatgataacagcccctccctgagaccaacccactccttgcctggggaccagaaagcctttgtaaaactaacacattggccacaagattagaaatgacggctcaggagtcatgcagccaaaggcctcgagatcatgaacctccccaattgctcctgtagataatattattattgtaaaacctaacatgggtgtttgaggtatttttcagaccctgccttctgatggatcagctggcaccacccagaccagtaaactggctcatctggtcttctggcccccacccaggaaccaactcagtgcaagaggatagcttcaactccttatgatttcatccccgacccaaccaatcagcattcccgcttcccgagccccctgcccgccaaactacctttaaaaaaccctagcctccaaattttcagggaggctgatttgagtaataataaaacccctgtctcctgtttaaaaaactctact

SEQ ID NO: 734056 - DNA, 513 bp, Homo sapiens; identical to SEQ ID NO: 429073

SEQ ID NO: 734057 - DNA, 908 bp, Homo sapiens
  misc_feature (888)..(888): n is a, c, g, or t
  misc_feature (892)..(892): n is a, c, g, or t
  misc_feature (897)..(897): n is a, c, g, or t
aatcagtcccattgcacgggaacacggggttttgaaacaaacagcagcctgtttttatttaaagtcgtgatcccttgcttatcgtagatttttttcataatttgattttggaaaatattgcacacaaatactactcgatccctgagtttgtgggcacttccttacattttgcacccatgaaaatgcctcctccgcctccaggtcaggctccctggaatggggtgtttagtgtcatttccagagacaagctggcagttggctcttgtgtcagagagaagcccacagtcacagtgacaccagcccgcactgtggaagggcttgctatgtgcagtgccctgagccaagtgttccacagacattatctcatttgaaccccatagcagccctggaaggaggcattgggtggggaaccaagttgtcctggggagtcagtgccaagatgtgagccccggacgcggcctcgtcactcacagccccgtgctcctcagctcccacccactgccgcttgacagtcgttttaatcactacctgggctgtggcgaacaatgccaggctctgatagatcctgctgtctcatttctcaacctagtttcccttaactaatatttcatggctatcgttaatgtgcgtttttcatcgagtaatttccacagcccgaacttgtaacacatcccaatgacaaacgtccccagttcggaagcccccgtcagtggcaatgtcacccttgctgctgcctcgacaccttccgacagcccattcagttttatgatcgccctgtcccagtgatcactactgaacctttaagaatccagatgcatttcaagtttaattgaataaaattctttgtataataaaaacccccttggccaaccccccaaaaaaagggcncccngcttntagaggagcga

SEQ ID NO: 734058 - DNA, 1439 bp, Homo sapiens; identical to SEQ ID NO: 17112

SEQ ID NO: 734059 - DNA, 1529 bp, Homo sapiens; identical to SEQ ID NO: 17114

SEQ ID NO: 734060 - DNA, 1942 bp, Homo sapiens; identical to SEQ ID NO: 17113

SEQ ID NO: 734061 - DNA, 1852 bp, Homo sapiens
gcagcccgaagcagccagaccagcccctgagcctcccgggtgctggcagctgtcatggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctggcctggaccccctccccagcctcagcccctagcctggcctctttgcatggggctgggggagatggggcgccgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggatacccagtccccacctccatccccacctctgtctcacctgacctcctgcgagggaggctggagactgtgtggacaggccgccctgaccgcaagcttccagaccctgggaggaggcctgcagaggactgtgctttgcctgatgcagggagctgggcccatcctggggcctatgagacctgagccaccctccgtcccccatcccacacatcagtggctgggcggggtgaggattcagaggcatctctactgcccctgggcacagcacctttctgagagtgggactctccatggtcatctgactaccaattctggccaccacctccaaccctcttgtgcatatggatggctctagcccttatccaccccctcaagcatttattaagcatctgctgtatgctacatacagtgttagacttggggcttcaggcatagccggtcctgaccttggggagatgccttctctagacctgagacgaccacgtgtccagatgtgacctgttgctgtcgggggtctatcaggcccttagaccgtcaccccagtaggctctccaggacccaggagcctccatcacctggaaggaccctctgtgcaaaacctcaagcgtccatctgtgcacaaggccggtggt

SEQ ID NO: 734062 - DNA, 2464 bp, Homo sapiens
tcgcccacgcgtccgacttgttgcagttgctgtaggattctaaatccaggtgattgtttcaaactgagcatcaacaacaaaaacatttgtatgatatctatatttcaatcatggaccaaaatcaacatttgaataaaacagcagaggcacaaccttcagagaataagaaaacaagatactgcaatggattgaagatgttcttggcagctctgtcactcagctttattgctaagacactaggtgcaattattatgaaaagttccatcattcatatagaacggagatttgagatatcctcttctcttgttggttttattgacggaagctttgaaattggaaatttgcttgtgattgtatttgtgagttactttggatccaaactacatagaccaaagttaattggaatcggttgtttcattatgggaattggaggtgttttgactgctttgccacatttcttcatgggatattacaggtattctaaagaaactaatatcaattcatcagaaaattcaacatcgaccttatccacttgtttaattaatcaaattttatcactcaatagagcatcacctgagatagtgggaaaaggttgtttaaaggaatctgggtcatacatgtggatatatgtgttcatgggtaatatgcttcgtggaataggggagactcccatagtaccactggggctttcttacattgatgatttcgctaaagaaggacattcttctttgtatttaggtatattgaatgcaatagcaatgattggtccaatcattggctttaccctgggatctctgttttctaaaatgtacgtggatattggatatgtagatctaagcactatcaggataactcctactgattctcgatgggttggagcttggtggcttaatttccttgtgtctggactattctccattatttcttccataccattctttttcttgccccaaactccaaataaaccacaaaaagaaagaaaagcttcactgtctttgcatgtgctggaaacaaatgatgaaaaggatcaaacagctaatttgaccaatcaaggaaaaaatattaccaaaaatgtgactggttttttccagtcttttaaaagcatccttactaatcccctgtatgttatgtttgtgcttttgacgttgttacaagtaagcagctatattggtgcttttacttatgtcttcaaatacgtagagcaacagtatggtcagccttcatctaaggctaacatcttattgggagtcataaccatacctatttttgcaagtggaatgtttttaggaggatatatcattaaaaaattcaaactgaacaccgttggaattgccaaattctcatgttttactgctgtgatgtcattgtccttttacctattatattttttcatactctgtgaaaacaaatcagttgccggactaaccatgacctatgatggaaataatccagtgacatctcatagagatgtaccactttcttattgcaactcagactgcaattgtgatgaaagtcaatgggaaccagtctgtggaaacaatggaataacttacatctcaccctgtctagcaggttgcaaatcttcaagtggcaataaaaagcctatagtgttttacaactgcagttgtttggaagtaactggtctccagaacagaaattactcagcccatttgggtgaatgcccaagagatgatgcttgtacaaggaaattttacttttttgttgcaatacaagtcttgaatttatttttctctgcacttggaggcacctcacatgtcatgctgattgttaaaattgttcaacctgaattgaaatcacttgcactgggtttccactcaatggttatacgagcactaggaggaattctagctccaatatattttggggctctgattgatacaacgtgtataaagtggtccaccaacaactgtggcacacgtgggtcatgtaggacatataattccacatcattttcaagggtctacttgggcttgtcttcaatgttaagagtctcatcacttgttttatatattatattaatttatgccatgaagaaaaaatatcaagagaaagatatcaatgcatcagaaaatggaagtgtcatggatgaagcaaacttagaatccttaaataaaaataaacattttgtcccttctgctggggcagatagtgaaacacattgttaaggggagaaaaaaagccacttctgcttctgtgtttccaaacagcattgcattgattcagtaagatgttatttttgaggagttcctggtcctttcactaagaatttccacatcttttatggtggaagtataaataagcctatgaacttataataaaacaaactgtaggtagaaaaaatgagagtactcattgttacattatagctacatatttgtggttaaggttagactatatgatccatacaaattaaagtgagagacatggttactgtgtaataaaa

SEQ ID NO: 734063 - DNA, 2794 bp, Homo sapiens; identical to SEQ ID NO: 16359
  misc_feature (2794)..(2794): n is a, c, g, or t

SEQ ID NO: 734064 - DNA, 2186 bp, Homo sapiens
tcgcccacgcgtccgacttgttgcagttgctgtaggattctaaatccaggtgattgtttcaaactgagcatcaacaacaaaaacatttgtatgatatctatatttcaatcatggaccaaaatcaacatttgaataaaacagcagaggcacaaccttcagagaataagaaaacaagatactgcaatggattgaagatgttcttggcagctctgtcactcagctttattgctaagacactaggtgcaattattatgaaaagttccatcattcatatagaacggagatttgagatatcctcttctcttgttggttttattgacggaagctttgaaattggaaatttgcttgtgattgtatttgtgagttactttggatccaaactacatagaccaaagttaattggaatcggttgtttcattatgggaattggaggtgttttgactgctttgccacatttcttcatgggatattacaggtattctaaagaaactaatatcaattcatcagaaaattcaacatcgaccttatccacttgtttaattaatcaaattttatcactcaatagagcatcacctgagatagtgggaaaaggttgtttaaaggaatctgggtcatacatgtggatatatgtgttcatgggtaatatgcttcgtggaataggggagactcccatagtaccactggggctttcttacattgatgatttcgctaaagaaggacattcttctttgtatttaggtatattgaatgcaatagcaatgattggtccaatcattggctttaccctgggatctctgttttctaaaatgtacgtggatattggatatgtagatctaagcactatcaggataactcctactgattctcgatgggttggagcttggtggcttaatttccttgtgtctggactattctccattatttcttccataccattctttttcttgccccaaactccaaataaaccacaaaaagaaagaaaagcttcactgtctttgcatgtgctggaaacaaatgatgaaaaggatcaaacagctaatttgaccaatcaaggaaaaaatattaccaaaaatgtgactggttttttccagtcttttaaaagcatccttactaatcccctgtatgttatgtttgtgcttttgacgttgttacaagtaagcagctatattggtgcttttacttatgtcttcaaatacgtagagcaacagtatggtcagccttcatctaaggctaacatcttattgggagtcataaccatacctatttttgcaagtggaatgtttttaggaggatatatcattaaaaaattcaaactgaacaccgttggaattgccaaattctcatgttttactgctgtgatgtcattgtccttttacctattatattttttcatactctgtgaaaacaaatcagttgccggactaaccatgacctatgatggaaataatccagtgacatctcatagagatgtaccactttcttattgcaactcagactgcaattgtgatgaaagtcaatgggaaccagtctgtggaaacaatggaataacttacatctcaccctgtctagcaggttgcaaatcttcaagtggcaataaaaagcctatagtgttttacaactgcagttgtttggaagtaactggtctccagaacagaaattactcagcccatttgggtgaatgcccaagagatgatgcttgtacaaggaaattttacttttttgttgcaatacaagtcttgaatttatttttctctgcacttggaggcacctcacatgtcatgctgattgttaaaattgttcaacctgaattgaaatcacttgcactgggtttccactcaatggttatacgagcactaggaggaattctagctccaatatattttggggctctgattgatacaacgtgtataaagtggtccaccaacaactgtggcacacgtgggtcatgtaggacatataattccacatcattttcaagggtctacttgggcttgtcttcaatgttaagagtctcatcacttgttttatatattatattaatttatgccatgaagaaaaaatatcaagagaaagatatcaatgcatcagaaaatggaagtgtcatggatgaagcaaacttagaatccttaaataaaaataaacattttgtcccttctgctggggcagatagtgaaacacattgttaa

SEQ ID NO: 734065 - DNA, 435 bp, Homo sapiens
aagggtctacttgggcttgtcttcaatgttaagagtctcatcacttgttttatatattatattaatttatgccatgaagaaaaaatatcaagagaaagatatcaatgcatcagaaaatggaagtgtcatggatgaagcaaacttagaatccttaaataaaaataaacattttgtcccttctgctggggcagatagtgaaacacattgttaaggggagaaaaaaagccacttctgcttctgtgtttccaaacagcattgcattgattcagtaagatgttatttttgaggagttcctggtcctttcactaagaatttccacatcttttatggtggaagtataaataagcctatgaacttataataaaacaaactgtaggtagaaactatatgatccatacaaattaaagtgagagacatggttactgtgtaataaaa

SEQ ID NO: 734066 - DNA, 813 bp, Homo sapiens; identical to SEQ ID NO: 16361

SEQ ID NO: 734067 - DNA, 2166 bp, Homo sapiens
aaactaaatattgctgcttggggacctccttctagccttaaatttcagctcatcaccttcacctgccttggtcatggctctgctattctccttgatccttgccatttgcaccagacctggattcctagcgtctccatctggagtgcggctggtggggggcctccaccgctgtgaagggcgggtggaggtggaacagaaaggccagtggggcaccgtgtgtgatgacggctgggacattaaggacgtggctgtgttgtgccgggagctgggctgtggagctgccagcggaacccctagtggtattttgtatgagccaccagcagaaaaagagcaaaaggtcctcatccaatcagtcagttgcacaggaacagaagatacattggctcagtgtgagcaagaagaagtttatgattgttcacatgatgaagatgctggggcatcgtgtgagaacccagagagctctttctccccagtcccagagggtgtcaggctggctgacggccctgggcattgcaagggacgcgtggaagtgaagcaccagaaccagtggtataccgtgtgccagacaggctggagcctccgggccgcaaaggtggtgtgccggcagctgggatgtgggagggctgtactgactcaaaaacgctgcaacaagcatgcctatggccgaaaacccatctggctgagccagatgtcatgctcaggacgagaagcaacccttcaggattgcccttctgggccttgggggaagaacacctgcaaccatgatgaagacacgtgggtcgaatgtgaagatccctttgacttgagactagtaggaggagacaacctctgctctgggcgactggaggtgctgcacaagggcgtatggggctctgtctgtgatgacaactggggagaaaaggaggaccaggtggtatgcaagcaactgggctgtgggaagtccctctctccctccttcagagaccggaaatgctatggccctggggttggccgcatctggctggataatgttcgttgctcaggggaggagcagtccctggagcagtgccagcacagattttgggggtttcacgactgcacccaccaggaagatgtggctgtcatctgctcaggatagtatcctggtgttgcttgacctggcccccctggccccgcctgccctctgcttgttctcctgagccctgattatcctcatactcattctggggctcaggcttgagccactactccctcatcccctcaggagtctgaacactgggcttatgccttactctcagggacaagcagcccccattgctgcctgtagatgtgagctgttgagttccctcttgctggggaagatgagcttccatgtatcctgtgctcaaccctgaccctttgacactggttctggcctttcctgccttttctcaagctgcctggaatcctcaaacctgtcactttggtcagatgtgcagaccattactaaggtctatgtctgcaaacattactaatctaggtcctattactaatctatgtctgcaaacattaaaggaatgaaacaatgaaaggaacatttgaaagaaaatgtgggtagacaatttcttgcaacttgggggaaagtttagaattcttttgattggactactttttttttttttcctcaagcttcaggtgaccacaatagcaacacctccctattctgttatttcttagtgtaggtagacaattctttcaggagcagagcagcgtcctataatcctagaccttttcatgacgtgtaaaaaatgatgtttcatcctctgattgccccaataaaaatctttgttgtccatccctatacaacctgccaacatggttgacatttaatgagaggaatgtcaaaaatacattttactttattcaaagaaaaatatattggttactgggaaaaggtcaagaaagaggcagaaagagatcagggagggctaaagttgtgtcttatgccaagcggaagtggaaaatatcacttttcactttatcaactgagactttggggcctgtaagcttgaggcaagacagaaataagagaatcaagacttgattgtaaaaattgacaactttagattctgaggctaggctgagtacttattatacggctacatttacacatttacacttatctaataaatcagatttcacagtctc

SEQ ID NO: 734068 - DNA, 1828 bp, Homo sapiens
aaactaaatattgctgcttggggacctccttctagccttaaatttcagctcatcaccttcacctgccttggtcatggctctgctattctccttgatccttgccatttgcaccagacctggattcctagcgtctccatctggagtgcggctggtggggggcctccaccgctgtgaagggcgggtggaggtggaacagaaaggccagtggggcaccgtgtgtgatgacggctgggacattaaggacgtggctgtgttgtgccgggagctgggctgtggagctgccagcggaacccctagtggtattttgtatgagccaccagcagaaaaagagcaaaaggtcctcatccaatcagtcagttgcacaggaacagaagatacattggctcagtgtgagcaagaagaagtttatgattgttcacatgatgaagatgctggggcatcgtgtgagaacccagagagctctttctccccagtcccagagggtgtcaggctggctgacggccctgggcattgcaagggacgcgtggaagtgaagcaccagaaccagtggtataccgtgtgccagacaggctggagcctccgggccgcaaaggtggtgtgccggcagctgggatgtgggagggctgtactgactcaaaaacgctgcaacaagcatgcctatggccgaaaacccatctggctgagccagatgtcatgctcaggacgagaagcaacccttcaggattgcccttctgggccttgggggaagaacacctgcaaccatgatgaagacacgtgggtcgaatgtgaagatccctttgacttgagactagtaggaggagacaacctctgctctgggcgactggaggtgctgcacaagggcgtatggggctctgtctgtgatgacaactggggagaaaaggaggaccaggtggtatgcaagcaactgggctgtgggaagtccctctctccctccttcagagaccggaaatgctatggccctggggttggccgcatctggctggataatgttcgttgctcaggggaggagcagtccctggagcagtgccagcacagattttgggggtttcacgactgcacccaccaggaagatgtggctgtcatctgctcaggatagtatcctggtgttgcttgacctggcccccctggccccgcctgccctctgcttgttctcctgagccctgattatcctcatactcattctggggctcaggcttgagccactactccctcatcccctcaggagtctgaacactgggcttatgccttactctcagggacaagcagcccccattgctgcctgtagatgtgagctgttgagttccctcttgctggggaagatgagcttccatgtatcctgtgctcaaccctgaccctttgacactggttctggcctttcctgccttttctcaagctgcctggaatcctcaaacctgtcactttggtcagatgtgcagaccattactaaggtctatgtctgcaaacattactaatctaggtcctattactaatctatgtctgcaaacattaaaggaatgaaacaatgaaaggaacatttgaaagaaaatgtgggtagacaatttcttgcaacttgggggaaagtttagaattcttttgattggactactttttttttttttcctcaagcttcaggtgaccacaatagcaacacctccctattctgttatttcttagtgtaggtagacaattctttcaggagcagagcagcgtcctataatcctagaccttttcatgacgtgtaaaaaatgatgtttcatcctctgattgccccaataaaaatctttgttgtccatccctatacaacctg

SEQ ID NO: 734069 - DNA, 1475 bp, Homo sapiens; identical to SEQ ID NO: 16190

SEQ ID NO: 734070 - DNA, 1137 bp, Homo sapiens
agcagttagtgcccagagaagaataaatacagctgcaggaggctagggtttgagccaggctgctgctactttgaagctgtgtaatgttagtcacttaactcctcagaacctaagtgtttccatgggtagaaatagaaagacacttgtccggtttacctcaaagactttgtgattgtgtgaggataagatatgttgatagatgtcagtactgtttgtgactcacatggagctagttgagtaagtccctgggatactgcacaaggttctggcctggctcacatcagtgtgggatctgtacatggcttagctctttttcctatgttgagccccagtcttctcccttagctaatgtgagtttcaactgaataattccttcctggactatacccatccttactgcattttcctcttctctttataggatagtatcctggtgttgcttgacctggcccccctggccccgcctgccctctgcttgttctcctgagccctgattatcctcatactcattctggggctcaggcttgagccactactccctcatcccctcaggagtctgaacactgggcttatgccttactctcagggacaagcagcccccattgctgcctgtagatgtgagctgttgagttccctcttgctggggaagatgagcttccatgtatcctgtgctcaaccctgaccctttgacactggttctggcctttcctgccttttctcaagctgcctggaatcctcaaacctgtcactttggtcagatgtgcagaccattactaaggtctatgtctgcaaacattactaatctaggtcctattactaatctatgtctgcaaacattaaaggaatgaaacaatgaaaggaacatttgaaagaaaatgtgggtagacaatttcttgcaacttgggggaaagtttagaattcttttgattggactactttttttttttttcctcaagcttcaggtgaccacaatagcaacacctccctattctgttatttcttagtgtaggtagacaattctttcaggagcagagcagcgtcctataatcctagaccttttcatgacgtgtaaaaaatgatgtttcatcctctgattgccccaataaaaatctttgttgtccatccctatacaacctg

SEQ ID NO: 734071 - DNA, 391 bp, Homo sapiens; identical to SEQ ID NO: 16191

SEQ ID NO: 734072 - DNA, 993 bp, Homo sapiens
atgccacgctccttcctggtgaagagcaagaaggctcacacctaccaccagccccgtgtgcaggaagatgaaccgctctggcctcatgcccttaccccggtgcccagagaccaggctccaagcaacagccctgtccttagcactctattcccaaaccagtgcctggactggaccaacctcaaacgagagccggagctggagcaggaccagaacttggccaggatggccccggcaccagagggccccattgtgctgtcccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggtcttctccacccctcacgggctcgaagtgcatgtgcgacgctcccatagtgggacccggcccttcgcctgtgacatctgcggcaaaaccttcggccacgctgtgagcctggagcagcacacgcacgtccactcccaggagcgcaacttcgagtgccgcatgtgcggcaaggccttcaagcgctcgtccacgctgtccacccacctgctcatccactcagacacgcggccctacccctgccagttctgcggcaagcgtttccaccagaagtccgacatgaagaagcacacctacatccacacaggtgagaagccgcacaagtgccaggtgtgcggaaaggccttcagccagagctccaacctcatcacccacagccgcaagcacacaggcttcaagcccttcagctgtgagctgtgcaccaaaggcttccagcgcaaggtggacctgcggcggcaccgcgagagccagcacaatctcaagtga

SEQ ID NO: 734073 - DNA, 2852 bp, Homo sapiens
gagatggagtcttgctctgtcgcccaggctggagtgcagtggcatcatctctgctcactgcaagctccgcctcccgggttcaccccacacgccattctcctgcctcagcctcctgagtagctgggagtacagctgccggccaccacgcccggctaattttttctatttttagtagagacggggtttcaccgtgttagccaagatggtctcgatctcctgacctcgtgatccgcccgcctcagcctcccaaagatctgggattacaggcgtgagccactgcacccggccagaagctttttcatttattcgtccagcagcatcttgtactagtccgaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaaattcaagttcttccagaaggaggtgaaacaccaatcttcaaacagttttttaaggactggagagataaagatcagagtgatggcttcgggaaagtttatgtcacagagaaagtggctcaaataaaacaaattccctttgatgcctcaaaattacacagttctccgcagatggcagcccagcacaatatggtggatgatggttctggcaaagtggagatttggcgtgtagaaaacaatggtaggatccaagttgaccaaaactcatatggtgaattctatggtggtgactgctacatcatactctacacctatcccagaggacagattatctacacgtggcaaggagcaaatgccacacgagatgagctgacaacatctgcgttcctgactgttcagttggatcggtcccttggaggacaggctgtgcagatccgagtctcccaaggcaaagagcctgttcacctactgagtttgttcaaagacaaaccgctcattatttacaagaatggaacatcaaagaaaggaggtcaggcacctgctccccctacacgcctctttcaagtccggagaaacctggcatctatcaccagaattgtggaggttgatgttgatgcaaattcactgaattctaacgatgtttttgtcctgaaactgccacaaaatagtggctacatctgggtaggaaaaggtgctagccaggaggaggagaaaggagcagagtatgtagcaagtgtcctaaagtgcaaaaccttaaggatccaagaaggcgaggagccagaggagttctggaattcccttggagggaaaaaagactaccagacctcaccactactggaaacccaggctgaagaccatccacctcggctttacggctgctctaacaaaactggaagatttgttattgaagagattccaggagagttcacccaggatgatttagctgaagatgatgtcatgttactagatgcttgggaacagatatttatttggattggcaaagatgctaatgaagttgagaaaaaagaatctctgaagtctgccaaaatgtaccttgagacagacccttctggaagagacaagaggacaccaattgtcatcataaaacagggccatgagccacccacattcacaggctggttcctgggctgggattccagcaagtggtaaattggtatttgtaaaaagcaaacaaacattacaaggcagttatctcattgctgttttgggagaggaacgggaaaagctttttgcttatttgtcttttgaaaattaaggctgggcgcggtggctcacacctgtaatcccagcactttgagaggatgaggtaggcggatcactggggtcaggatttcgagaccagcctggccaacatggcgaaacctcgcctctactaaaaatacaaaaaaattagctgcgcgtggtggtgcacgcctgtagtccctgctacttggaaggctgagacaggaaaattgcttgaacccaggaggctgaggttgcagtgagccaggattgcgccaccacactccagcctgggcaacagagactctgtctcaaaaaaaaaaaaaaaaaaaattaacctcaaccaaacgcctattttttaatgcttagttttggcttgaaattcttcttcacctggagttttcttacgttaatacattaaaataacctgaaggaaactttcgttatgggccaatattagctcttatggaaactgatttatatcttttttatgacctttcaaaagtaaaatactatgcataatctagaaagatttgtcagataggaaattttataatgcattagccattagtcagagttgttttttaacatgccagagaaaaagttgtaatgccttggaagttattctcttttctatagattgtgttcaaaagatgtgtatacttgcaataaggtttatgttaaggtggctttaacaattggttgctattttccttctttagtcaatatgactttgatgtcattaactgctaagtgttattttctaagaggaattttatcttttttttaaccttattaaaagcctttgaaaacac

SEQ ID NO: 734074 - DNA, 5679 bp, Homo sapiens
gagatggagtcttgctctgtcgcccaggctggagtgcagtggcatcatctctgctcactgcaagctccgcctcccgggttcaccccacacgccattctcctgcctcagcctcctgagtagctgggagtacagctgccggccaccacgcccggctaattttttctatttttagtagagacggggtttcaccgtgttagccaagatggtctcgatctcctgacctcgtgatccgcccgcctcagcctcccaaagatctgggattacaggcgtgagccactgcacccggccagaagctttttcatttattcgtccagcagcatcttgtactagtcctgactggttagtatagaaacagcactcctcttctaaaaagatacacaggccgcctttctcggcagtgaggagatctaaacctcgatggttttgaagtgtcactgctgcttaaagagtcttttggaattggagagcaagtctatttgggattggagaccccttcgtggggttttgggagggcctggtcggcttgttggcagaggagatagctcatgagggagactgttgggaggtattctcctagctgagagttagaagggggcctgttttgtaagaggaaagggcgtccgtatattaactcaaatggactgaggaaggagggtgcttttggactggctctaatgctctccagtgctatgggcaaaagggaggtccatggtttttggacttcaagagtgagtttggttaactgagccttaaggatcccatttgccctttcgacttttccggatgtctggggccagcatgggatatggagacgccactggatgccaagggactgagaaacctgttgagtgatttgggagatgaagctaggggccattgtctgattgtatggagccagggagaccaaatgtagggatgatttctgttacaagaatttgggagacttctgcggccttttctgaagaggtaggaaatgcttctacccacctagagaaggtgtctataagagtaagaataaattttgtcctcttgacgggatgaatgtgggtgaagtctatttgccagtcctcccctgggagtgttcctctgaggggatgtgtagggatggagggagagtggagggccccttgggaggaagtaacagagcatataggacagtttgaggttatgtctcttagtgaggtgaatagatggggggaggagaaatagggtgaaggagtaggtatgggggcgcacactgatatggaaggattggtgaagagatgtcagaatttctttggtctgctcttaggggaggacgagcttttgatttttgactatccagtccccttgaaaggaggctccttgctgtatagcaaagctttctcggtgggagagttcttgggtaggattgctgggataacaggaaggagaggggcagaggcagaagaaagggaggcttcttttgctgcctcatcggcctttctgttgcctcgagatttcatctgaacctgttcgatgtcctcaacagtgtataactcctgctttagctgggaggtgtgtggcctgaaggagttagtaaataaggtggccattagtgataggggttcctttggcagtaaggagtcctctcttttgccagatagcagcgtgggaacgaggaatgtgataggcatatttggagtctgtataaatgttgactcgtttgcctttggaaagatttagggccctggtgagagctatgagttctgctttttgggaggaggatcctggcttcaattacttggtcaagggaaacaactgcatatccagcaatctggggggtagctggtgggcctggaagaggagccatctatgaatagttgatcatcggggttggtgagaggctcggaggaaatgtttgggaaatgtggctgtacgtggtccaggatatcagtggaagaatgagtaggaagggaagaggatacggggagtaaggatgctgggttgagggaagcacttctggtaagactgaatttgggattttttataaagagggcatggagtaattgaatcctggaaggaggaagggagcttactgcttgggaggagaggagatcttgtagattatgagaactgtggacggtggtattctggctgaaagttagtttcctgctttctagagctaagctggctaccacttctagtgctttaaagcaggctggccaccctttgactgtgttatctagttgtttagagaggtaagctacaggggcaaaggaaggaggatttcctttctgttgtcctaagacaccgagggctattcctcagctttcagcagtatagagagtgaaaggttgggagatatcaggtaaggacggagctgacgcagtgacaagagcagtttggagtttgtggaagctggggagtatgttatgtgaggggtttaggggttcattgggagggcctttggccacttcatagaggggatgagctaggagggcaaagttggaaatccatattctaaagaagcctgctagccctgggaaggaaaggatttcgcttttggaggagggtgggggtagattttctattaatgctgccctggctggagtcatagcctgggccccaggggaaagttgaattcctaagtaagtcatcatggagatggagagttgggccttggagggggagaccctataccctttgatagcgagaaagtttaagagagcagtggccgtgtgagtttgagagtcttttagagaggggctgcaaagaagaaggtcgtccacatattgaagatgactgggagacaggtttaaggaagtgaggtttcgggctagagcttgtccaaagaaatgagggctatccctgaagccctgagggaggacagtccatgtgagttgttgtgactggagggtgtcagggtcagtccaggtgaaagcaaataggttttgggaatcagggtgtagggaaatggtaaagaaggcatccttcaggtcaattgcagtgtagagggtggtgttggtagcgacgagagagagaagtggataggggttatggactatgggatgaatagggaggacagcttgactgatggcttggaggttgtgaacgagtcggtatgagccatcagactttttaacagggaggataggggtgttatatggagagtgtgttggtctaagaagactgcatgagcagagcttgtttacgatgggctgtaggcccttttggtgggttagagagatggggtattgaggaacgttgggaaatttggaagagtcttttaactggattctgatggggtcatggtgagcagctacggaagggttaatgagagaggcaggaagtgggtactggggaaaggggtcaggggccggactagcggagaggagcaggaggggactctggttgaagggggcaagaaaaggtgatagaagctttgactttggctaaaaggtctcagcctagaatgggggtggggcaatgaggcatgataaggaaagagtgtgagaaaatggcatcaaacagggaacaagtaagaggtctggtggcaagcggacaagagatgagtccgtcaacccccacaactgagacttgagagggatgagtgggtcctgagaactcaggcaaagctgagtaggtggccccactatcaattaaaaaagagatcagcttacctgctactagtagagttaccctgggctccgatgcagtgatggcagtgggggccgggagccggggcccaggggccctggcctcatcagtcttcagtggctaggccaaggagctatgggagtgcaagtgattcttcactttttgtcttgttgaagggatggtggctctgaggagcatgcttgtctgcccatctgttgagaggacagtcagacttccagtgcccatctgctggcagactaggcaagggctcttcggcactcatgggtggggacatgcccccgtccagtggccttctttgccgcacttaaaacaaggcccaggaggtttgctgctatcaggtcttttgtgcccttgggtactatggctagactgacagatagccactgctggaagctggtatttagcacgatctctttgggctttatctaatttattttgctcgtccctgttattaaagactttgaaagccaggttaaggaggtcttgttgtggggtttgagagccatcttcagcctttttaagtttgtgccggatgtcaggggcagattgggaaataaaatgggtattaagaacaatagttcctacatatgtaacaaacctgcacattgtgcacatgtaccctaaaacttaaagtataataataattaaaaaataaataaaattttttaaagaaagaacaatagttccttctcaggaggcagggtcgatgcgggtatatttttggagagcttctgtaaggcgggaaagagattgggcaggattttcatctgccttttgggaaatgtctttaagtttttcaaaatttacagcctatgggcagctttgttaaggcctgcaatgaggcaagtaatcatatggctacagtacacttggccaggttctgtgggttggtattcccaggaaggctcttcccagggaacagcagcagctcctacgggcttagtaggatcctgctgatgaaggtcatcggcatatgcctgtgctgcgagccacactctttccttctcttctggaaggagggtagaagagaggataaagtagagatcatgccaagtgagttcataagattgagtaagatatttaaattctttgatgtaagtatcaggatcggaggagaaggacccgagacgttcttcaatctgtaagagatcgtagaaggagaaagggacgtggacatggacgatcccctcaactcccgctacttcccggagaggaagcaagggagctggttgctgagcacattgggcccgagagcgggtgaggggaggaggcagagaggactcagagtcagaagtgggttggttggagagagtgggggagaggggtagagccggagcagggacatacggtggaggatcatgatgctctggtggaggatcatgatgctgtcgaggagggagaaaatccacggggtcaaaggaagaggagtcatcggctgggtctgtgggtggggtgacgggagatgagtcaggttttgagctggtgagtaggatttggaaagtagagcaggagtggcagagagaagggtggttacggagaatgaagaaagcctgaatataaggaatctcagaccatttctcattgcgatggcaaaagttgtctaagtctctaagtatattgaaatcgaaagtgccattttcgggccattgggagccattgtccaattggtattgaggccatgcagtattgcagtaaaagataagcctcttagaacggatccctgaacggaggccgagagccttgcgattgcggaggagacacccaaggggggtggtcttgggaggggtagactgagaggctcccatagtgaatggaggaggtgagggtagaggaagaagggaccacagacgacaaagacgagagagggcggcgcctgtcttgcaggccttgtatggaatagaggaggtagctgcggagtcaggcgtccaggaaacagaggaaccagaggcctggaggccagaggaagcccttggcccagcgctgggtcttttgggagtgaagagatggtcaagggttccaggtaataggcaaaagtctctc

SEQ ID NO: 734075 - DNA, 3747 bp, Homo sapiens
aatgaaatgacagaattgatcattaggatgcttgttactcaaaaagcccattttttaaagaaggatgtattaaaattattccagcatgctaatgtggcacactcctctgctgcctaacggcaggtgttgctattagcagaggaagccttgttctaagaattattctagagggccagaaagaacaggtattgctccacccgagtaaacgctgactcaactctgcagggctggcgcgctctttcctcacctcacccctcctgccaggcacaactgagatccagaaataagaggattagcgagagaaggggaaatatgcaggacggtagtgatgggtatgcacaaaggagtgccaagcagttttaaccgttaatgttcttcgtctattgctagagaaaatgtctttccttggaggaggcattggcacgagttactataaactccctctgaatctcaagacttctgggacgccgattccgctcctggcctggggcaaggcgtgggagcttggaagccagcgctgcgctccccgtgggaagcgatcgtctcctctgtcaactcgcgcctgggcacttagcccctcccgtttcagggcgccgcctccccggatggcaaacactataaagtggcggcgaataaggttcctcctgctgctctcggtttagtccaagatcagcgatatcacgcgtcccccggagcatcgcgtgcaggagccatggcgcgggagctataccacgaagagttcgcccgggcgggcaagcaggcggggctgcaggtctggaggattgagaagctggagctggtgcccgtgccccagagcgctcacggcgacttctacgtcggggatgcctacctggtgctgcacacggccaagacgagccgaggcttcacctaccgcctgcacttctggctcggaaaggagtgttcccaggatgaaagcacagctgctgccatcttcactgttcagatggatgactatttgggtggcaagccagtgcagaatagagaacttcaaggatatgagtctaatgactttgttagctatttcaaaggcggtctgaaatacaaggctggaggcgtggcatctggattaaatcatgttcttacgaacgacctgacagccaagaggctcctacatgtgaagggtcgtagagtggtgagagccacagaagttccccttagctgggacagtttcaacaagggtgactgcttcatcattgaccttggcaccgaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaaattcaagttcttccagaaggaggtgaaacaccaatcttcaaacagttttttaaggactggagagataaagatcagagtgatggcttcgggaaagtttatgtcacagagaaagtggctcaaataaaacaaattccctttgatgcctcaaaattacacagttctccgcagatggcagcccagcacaatatggtggatgatggttctggcaaagtggagatttggcgtgtagaaaacaatggtaggatccaagttgaccaaaactcatatggtgaattctatggtggtgactgctacatcatactctacacctatcccagaggacagattatctacacgtggcaaggagcaaatgccacacgagatgagctgacaacatctgcgttcctgactgttcagttggatcggtcccttggaggacaggctgtgcagatccgagtctcccaaggcaaagagcctgttcacctactgagtttgttcaaagacaaaccgctcattatttacaagaatggaacatcaaagaaaggaggtcaggcacctgctccccctacacgcctctttcaagtccggagaaacctggcatctatcaccagaattgtggaggttgatgttgatgcaaattcactgaattctaacgatgtttttgtcctgaaactgccacaaaatagtggctacatctgggtaggaaaaggtgctagccaggaggaggagaaaggagcagagtatgtagcaagtgtcctaaagtgcaaaaccttaaggatccaagaaggcgaggagccagaggagttctggaattcccttggagggaaaaaagactaccagacctcaccactactggaaacccaggctgaagaccatccacctcggctttacggctgctctaacaaaactggaagatttgttattgaagagattccaggagagttcacccaggatgatttagctgaagatgatgtcatgttactagatgcttgggaacagatatttatttggattggcaaagatgctaatgaagttgagaaaaaagaatctctgaagtctgccaaaatgtaccttgagacagacccttctggaagagacaagaggacaccaattgtcatcataaaacagggccatgagccacccacattcacaggctggttcctgggctgggattccagcaagtggtaaattggtatttgtaaaaagcaaacaaacattacaaggcagttatctcattgctgttttgggagaggaacgggaaaagctttttgcttatttgtcttttgaaaattaaggctgggcgcggtggctcacacctgtaatcccagcactttgagaggatgaggtaggcggatcactggggtcaggatttcgagaccagcctggccaacatggcgaaacctcgcctctactaaaaatacaaaaaaattagctgcgcgtggtggtgcacgcctgtagtccctgctacttggaaggctgagacaggaaaattgcttgaacccaggaggctgaggttgcagtgagccaggattgcgccaccacactccagcctgggcaacagagactctgtctcaaaaaaaaaaaaaaaaaaaattaacctcaaccaaacgcctattttttaatgcttagttttggcttgaaattcttcttcacctggagttttcttacgttaatacattaaaataacctgaaggaaactttcgttatgggccaatattagctcttatggaaactgatttatatcttttttatgacctttcaaaagtaaaatactatgcataatctagaaagatttgtcagataggaaattttataatgcattagccattagtcagagttgttttttaacatgccagagaaaaagttgtaatgccttggaagttattctcttttctatagattgtgttcaaaagatgtgtatacttgcaataaggtttatgttaaggtggctttaacaattggttgctattttccttctttagtcaatatgactttgatgtcattaactgctaagtgttattttctaagaggaattttatcttttttttaaccttattaaaagcctttgaaaacac

SEQ ID NO: 734076 - DNA, 2217 bp, Homo sapiens; identical to SEQ ID NO: 277039

SEQ ID NO: 734077 - DNA, 3665 bp, Homo sapiens
gagatggagtcttgctctgtcgcccaggctggagtgcagtggcatcatctctgctcactgcaagctccgcctcccgggttcaccccacacgccattctcctgcctcagcctcctgagtagctgggagtacagctgccggccaccacgcccggctaattttttctatttttagtagagacggggtttcaccgtgttagccaagatggtctcgatctcctgacctcgtgatccgcccgcctcagcctcccaaagatctgggattacaggcgtgagccactgcacccggccagaagctttttcatttattcgtccagcagcatcttgtactagtcctgactggttagtatagaaacagcactcctcttctaaaaagatacacaggccgcctttctcggcagtgaggagatctaaacctcgatggttttgaagtgtcactgctgcttaaagagtcttttggaattggagagcaagtctatttgggattggagaccccttcgtggggttttgggagggcctggtcggcttgttggcagaggagatagctcatgagggagactgttgggaggtattctcctagctgagagttagaagggggcctgttttgtaagaggaaagggcgtccgtatattaactcaaatggactgaggaaggagggtgcttttggactggctctaatgctctccagtgctatgggcaaaagggaggtccatggtttttggacttcaagagtgagtttggttaactgagccttaaggatcccatttgccctttcgacttttccggatgtctggggccagcatgggatatggagacgccactggatgccaagggactgagaaacctgttgagtgatttgggagatgaagctaggggccattgtctgattgtatggagccagggagaccaaatgtagggatgatttctgttacaagaatttgggagacttctgcggccttttctgaagaggtaggaaatgcttctacccacctagagaaggtgtctataagagtaagaataaattttgtcctcttgacgggatgaatgtgggtgaagtctatttgccagtcctcccctgggagtgttcctctgaggggatgtgtagggatggagggagagtggagggccccttgggaggaagtaacagagcatataggacagtttgaggttatgtctcttagtgaggtgaatagatggggggaggagaaatagggtgaaggagtaggtatgggggcgcacactgatatggaaggattggtgaagagatgtcagaatttctttggtctgctcttaggggaggacgagcttttgatttttgactatccagtccccttgaaaggaggctccttgctgtatagcaaagctttctcggtgggagagttcttgggtaggattgctgggataacaggaaggagaggggcagaggcagaagaaagggaggcttcttttgctgcctcatcggcctttctgttgcctcgagatttcatctgaacctgttcgatgtcctcaacagtgtataactcctgctttagctgggaggtgtgtggcctgaaggagttagtaaataaggtggccattagtgataggggttcctttggcagtaaggagtcctctcttttgccagatagcagcgtgggaacgaggaatgtgataggcatatttggagtctgtataaatgttgactcgtttgcctttggaaagatttagggccctggtgagagctatgagttctgctttttgggaggaggatcctggcttcaattacttggtcaagggaaacaactgcatatccagcaatctggggggtagctggtgggcctggaagaggagccatctatgaatagttgatcatcggggttggtgagaggctcggaggaaatgtttgggaaatgtggctgtacgtggtccaggatatcagtggaagaatgagtaggaagggaagaggatacggggagtaaggatgctgggttgagggaagcacttctggtaagactgaatttgggattttttataaagagggcatggagtaattgaatcctggaaggaggaagggagcttactgcttgggaggagaggagatcttgtagattatgagaactgtggacggtggtattctggctgaaagttagtttcctgctttctagagctaagctggctaccacttctagtgctttaaagcaggctggccaccctttgactgtgttatctagttgtttagagaggtaagctacaggggcaaaggaaggaggatttcctttctgttgtcctaagacaccgagggctattcctcagctttcagcagtatagagagtgaaaggttgggagatatcaggtaaggacggagctgacgcagtgacaagagcagtttggagtttgtggaagctggggagtatgttatgtgaggggtttaggggttcattgggagggcctttggccacttcatagaggggatgagctaggagggcaaagttggaaatccatattctaaagaagcctgctagccctgggaaggaaaggatttcgcttttggaggagggtgggggtagattttctattaatgctgccctggctggagtcatagcctgggccccaggggaaagttgaattcctaagtaagtcatcatggagatggagagttgggccttggagggggagaccctataccctttgatagcgagaaagtttaagagagcagtggccgtgtgagtttgagagtcttttagagaggggctgcaaagaagaaggtcgtccacatattgaagatgactgggagacaggtttaaggaagtgaggtttcgggctagagcttgtccaaagaaatgagggctatccctgaagccctgagggaggacagtccatgtgagttgttgtgactggagggtgtcagggtcagtccaggtgaaagcaaataggttttgggaatcagggtgtagggaaatggtaaagaaggcatccttcaggtcaattgcagtgtagagggtggtgttggtagcgacgagagagagaagtggataggggttatggactatgggatgaatagggaggacagcttgactgatggcttggaggttgtgaacgagtcggtatgagccatcagactttttaacagggaggataggggtgttatatggagagtgtgttggtctaagaagactgcatgagcagagcttgtttacgatgggctgtaggcccttttggtgggttagagagatggggtattgaggaacgttgggaaatttggaagagtcttttaactggattctgatggggtcatggtgagcagctacggaagggttaatgagagaggcaggaagtgggtactggggaaaggggtcaggggccggactagcggagaggagcaggaggggactctggttgaagggggcaagaaaaggtgatagaagctttgactttggctaaaaggtctcagcctagaatgggggtggggcaatgaggcatgataaggaaagagtgtgagaaaatggcatcaaacagggaacaagtaagaggtctggtggcaagcggacaagagatgagtccgtcaacccccacaactgagacttgagagggatgagtgggtcctgagaactcaggcaaagctgagtaggtggccccactatcaattaaaaaagagatcaccgcgggtggagtacacccgccgtgggccg

SEQ ID NO: 734078 - DNA, 5586 bp, Homo sapiens
gagatggagtcttgctctgtcgcccaggctggagtgcagtggcatcatctctgctcactgcaagctccgcctcccgggttcaccccacacgccattctcctgcctcagcctcctgagtagctgggagtacagctgccggccaccacgcccggctaattttttctatttttagtagagacggggtttcaccgtgttagccaagatggtctcgatctcctgacctcgtgatccgcccgcctcagcctcccaaagatctgggattacaggcgtgagccactgcacccggccagaagctttttcatttattcgtccagcagcatcttgtactagtcctgactggttagtatagaaacagcactcctcttctaaaaagatacacaggccgcctttctcggcagtgaggagatctaaacctcgatggttttgaagtgtcactgctgcttaaagagtcttttggaattggagagcaagtctatttgggattggagaccccttcgtggggttttgggagggcctggtcggcttgttggcagaggagatagctcatgagggagactgttgggaggtattctcctagctgagagttagaagggggcctgttttgtaagaggaaagggcgtccgtatattaactcaaatggactgaggaaggagggtgcttttggactggctctaatgctctccagtgctatgggcaaaagggaggtccatggtttttggacttcaagagtgagtttggttaactgagccttaaggatcccatttgccctttcgacttttccggatgtctggggccagcatgggatatggagacgccactggatgccaagggactgagaaacctgttgagtgatttgggagatgaagctaggggccattgtctgattgtatggagccagggagaccaaatgtagggatgatttctgttacaagaatttgggagacttctgcggccttttctgaagaggtaggaaatgcttctacccacctagagaaggtgtctataagagtaagaataaattttgtcctcttgacgggatgaatgtgggtgaagtctatttgccagtcctcccctgggagtgttcctctgaggggatgtgtagggatggagggagagtggagggccccttgggaggaagtaacagagcatataggacagtttgaggttatgtctcttagtgaggtgaatagatggggggaggagaaatagggtgaaggagtaggtatgggggcgcacactgatatggaaggattggtgaagagatgtcagaatttctttggtctgctcttaggggaggacgagcttttgatttttgactatccagtccccttgaaaggaggctccttgctgtatagcaaagctttctcggtgggagagttcttgggtaggattgctgggataacaggaaggagaggggcagaggcagaagaaagggaggcttcttttgctgcctcatcggcctttctgttgcctcgagatttcatctgaacctgttcgatgtcctcaacagtgtataactcctgctttagctgggaggtgtgtggcctgaaggagttagtaaataaggtggccattagtgataggggttcctttggcagtaaggagtcctctcttttgccagatagcagcgtgggaacgaggaatgtgataggcatatttggagtctgtataaatgttgactcgtttgcctttggaaagatttagggccctggtgagagctatgagttctgctttttgggaggaggatcctggcttcaattacttggtcaagggaaacaactgcatatccagcaatctggggggtagctggtgggcctggaagaggagccatctatgaatagttgatcatcggggttggtgagaggctcggaggaaatgtttgggaaatgtggctgtacgtggtccaggatatcagtggaagaatgagtaggaagggaagaggatacggggagtaaggatgctgggttgagggaagcacttctggtaagactgaatttgggattttttataaagagggcatggagtaattgaatcctggaaggaggaagggagcttactgcttgggaggagaggagatcttgtagattatgagaactgtggacggtggtattctggctgaaagttagtttcctgctttctagagctaagctggctaccacttctagtgctttaaagcaggctggccaccctttgactgtgttatctagttgtttagagaggtaagctacaggggcaaaggaaggaggatttcctttctgttgtcctaagacaccgagggctattcctcagctttcagcagtatagagagtgaaaggttgggagatatcaggtaaggacggagctgacgcagtgacaagagcagtttggagtttgtggaagctggggagtatgttatgtgaggggtttaggggttcattgggagggcctttggccacttcatagaggggatgagctaggagggcaaagttggaaatccatattctaaagaagcctgctagccctgggaaggaaaggatttcgcttttggaggagggtgggggtagattttctattaatgctgccctggctggagtcatagcctgggccccaggggaaagttgaattcctaagtaagtcatcatggagatggagagttgggccttggagggggagaccctataccctttgatagcgagaaagtttaagagagcagtggccgtgtgagtttgagagtcttttagagaggggctgcaaagaagaaggtcgtccacatattgaagatgactgggagacaggtttaaggaagtgaggtttcgggctagagcttgtccaaagaaatgagggctatccctgaagccctgagggaggacagtccatgtgagttgttgtgactggagggtgtcagggtcagtccaggtgaaagcaaataggttttgggaatcagggtgtagggaaatggtaaagaaggcatccttcaggtcaattgcagtgtagagggtggtgttggtagcgacgagagagagaagtggataggggttatggactatgggatgaatagggaggacagcttgactgatggcttggaggttgtgaacgagtcggtatgagccatcagactttttaacagggaggataggggtgttatatggagagtgtgttggtctaagaagactgcatgagcagagcttgtttacgatgggctgtaggcccttttggtgggttagagagatggggtattgaggaacgttgggaaatttggaagagtcttttaactggattctgatggggtcatggtgagcagctacggaagggttaatgagagaggcaggaagtgggtactggggaaaggggtcaggggccggactagcggagaggagcaggaggggactctggttgaagggggcaagaaaaggtgatagaagctttgactttggctaaaaggtctcagcctagaatgggggtggggcaatgaggcatgataaggaaagagtgtgagaaaatggcatcaaacagggaacaagtaagaggtctggtggcaagcggacaagagatgagtccgtcaacccccacaactgagacttgagagggatgagtgggtcctgagaactcaggcaaagctgagtaggtggccccactatcaattaaaaaagagatcatcttcagtggctaggccaaggagctatgggagtgcaagtgattcttcactttttgtcttgttgaagggatggtggctctgaggagcatgcttgtctgcccatctgttgagaggacagtcagacttccagtgcccatctgctggcagactaggcaagggctcttcggcactcatgggtggggacatgcccccgtccagtggccttctttgccgcacttaaaacaaggcccaggaggtttgctgctatcaggtcttttgtgcccttgggtactatggctagactgacagatagccactgctggaagctggtatttagcacgatctctttgggctttatctaatttattttgctcgtccctgttattaaagactttgaaagccaggttaaggaggtcttgttgtggggtttgagagccatcttcagcctttttaagtttgtgccggatgtcaggggcagattgggaaataaaatgggtattaagaacaatagttcctacatatgtaacaaacctgcacattgtgcacatgtaccctaaaacttaaagtataataataattaaaaaataaataaaattttttaaagaaagaacaatagttccttctcaggaggcagggtcgatgcgggtatatttttggagagcttctgtaaggcgggaaagagattgggcaggattttcatctgccttttgggaaatgtctttaagtttttcaaaatttacagcctatgggcagctttgttaaggcctgcaatgaggcaagtaatcatatggctacagtacacttggccaggttctgtgggttggtattcccaggaaggctcttcccagggaacagcagcagctcctacgggcttagtaggatcctgctgatgaaggtcatcggcatatgcctgtgctgcgagccacactctttccttctcttctggaaggagggtagaagagaggataaagtagagatcatgccaagtgagttcataagattgagtaagatatttaaattctttgatgtaagtatcaggatcggaggagaaggacccgagacgttcttcaatctgtaagagatcgtagaaggagaaagggacgtggacatggacgatcccctcaactcccgctacttcccggagaggaagcaagggagctggttgctgagcacattgggcccgagagcgggtgaggggaggaggcagagaggactcagagtcagaagtgggttggttggagagagtgggggagaggggtagagccggagcagggacatacggtggaggatcatgatgctctggtggaggatcatgatgctgtcgaggagggagaaaatccacggggtcaaaggaagaggagtcatcggctgggtctgtgggtggggtgacgggagatgagtcaggttttgagctggtgagtaggatttggaaagtagagcaggagtggcagagagaagggtggttacggagaatgaagaaagcctgaatataaggaatctcagaccatttctcattgcgatggcaaaagttgtctaagtctctaagtatattgaaatcgaaagtgccattttcgggccattgggagccattgtccaattggtattgaggccatgcagtattgcagtaaaagataagcctcttagaacggatccctgaacggaggccgagagccttgcgattgcggaggagacacccaaggggggtggtcttgggaggggtagactgagaggctcccatagtgaatggaggaggtgagggtagaggaagaagggaccacagacgacaaagacgagagagggcggcgcctgtcttgcaggccttgtatggaatagaggaggtagctgcggagtcaggcgtccaggaaacagaggaaccagaggcctggaggccagaggaagcccttggcccagcgctgggtcttttgggagtgaagagatggtcaagggttccaggtaataggcaaaagtctctc

SEQ ID NO: 734079 - DNA, 3610 bp, Homo sapiens
  misc_feature (3609)..(3609): n is a, c, g, or t
gagatggagtcttgctctgtcgcccaggctggagtgcagtggcatcatctctgctcactgcaagctccgcctcccgggttcaccccacacgccattctcctgcctcagcctcctgagtagctgggagtacagctgccggccaccacgcccggctaattttttctatttttagtagagacggggtttcaccgtgttagccaagatggtctcgatctcctgacctcgtgatccgcccgcctcagcctcccaaagatctgggattacaggcgtgagccactgcacccggccagaagctttttcatttattcgtccagcagcatcttgtactagtcctgactggttagtatagaaacagcactcctcttctaaaaagatacacaggccgcctttctcggcagtgaggagatctaaacctcgatggttttgaagtgtcactgctgcttaaagagtcttttggaattggagagcaagtctatttgggattggagaccccttcgtggggttttgggagggcctggtcggcttgttggcagaggagatagctcatgagggagactgttgggaggtattctcctagctgagagttagaagggggcctgttttgtaagaggaaagggcgtccgtatattaactcaaatggactgaggaaggagggtgcttttggactggctctaatgctctccagtgctatgggcaaaagggaggtccatggtttttggacttcaagagtgagtttggttaactgagccttaaggatcccatttgccctttcgacttttccggatgtctggggccagcatgggatatggagacgccactggatgccaagggactgagaaacctgttgagtgatttgggagatgaagctaggggccattgtctgattgtatggagccagggagaccaaatgtagggatgatttctgttacaagaatttgggagacttctgcggccttttctgaagaggtaggaaatgcttctacccacctagagaaggtgtctataagagtaagaataaattttgtcctcttgacgggatgaatgtgggtgaagtctatttgccagtcctcccctgggagtgttcctctgaggggatgtgtagggatggagggagagtggagggccccttgggaggaagtaacagagcatataggacagtttgaggttatgtctcttagtgaggtgaatagatggggggaggagaaatagggtgaaggagtaggtatgggggcgcacactgatatggaaggattggtgaagagatgtcagaatttctttggtctgctcttaggggaggacgagcttttgatttttgactatccagtccccttgaaaggaggctccttgctgtatagcaaagctttctcggtgggagagttcttgggtaggattgctgggataacaggaaggagaggggcagaggcagaagaaagggaggcttcttttgctgcctcatcggcctttctgttgcctcgagatttcatctgaacctgttcgatgtcctcaacagtgtataactcctgctttagctgggaggtgtgtggcctgaaggagttagtaaataaggtggccattagtgataggggttcctttggcagtaaggagtcctctcttttgccagatagcagcgtgggaacgaggaatgtgataggcatatttggagtctgtataaatgttgactcgtttgcctttggaaagatttagggccctggtgagagctatgagttctgctttttgggaggaggatcctggcttcaattacttggtcaagggaaacaactgcatatccagcaatctggggggtagctggtgggcctggaagaggagccatctatgaatagttgatcatcggggttggtgagaggctcggaggaaatgtttgggaaatgtggctgtacgtggtccaggatatcagtggaagaatgagtaggaagggaagaggatacggggagtaaggatgctgggttgagggaagcacttctggtaagactgaatttgggattttttataaagagggcatggagtaattgaatcctggaaggaggaagggagcttactgcttgggaggagaggagatcttgtagattatgagaactgtggacggtggtattctggctgaaagttagtttcctgctttctagagctaagctggctaccacttctagtgctttaaagcaggctggccaccctttgactgtgttatctagttgtttagagaggtaagctacaggggcaaaggaaggaggatttcctttctgttgtcctaagacaccgagggctattcctcagctttcagcagtatagagagtgaaaggttgggagatatcaggtaaggacggagctgacgcagtgacaagagcagtttggagtttgtggaagctggggagtatgttatgtgaggggtttaggggttcattgggagggcctttggccacttcatagaggggatgagctaggagggcaaagttggaaatccatattctaaagaagcctgctagccctgggaaggaaaggatttcgcttttggaggagggtgggggtagattttctattaatgctgccctggctggagtcatagcctgggccccaggggaaagttgaattcctaagtaagtcatcatggagatggagagttgggccttggagggggagaccctataccctttgatagcgagaaagtttaagagagcagtggccgtgtgagtttgagagtcttttagagaggggctgcaaagaagaaggtcgtccacatattgaagatgactgggagacaggtttaaggaagtgaggtttcgggctagagcttgtccaaagaaatgagggctatccctgaagccctgagggaggacagtccatgtgagttgttgtgactggagggtgtcagggtcagtccaggtgaaagcaaataggttttgggaatcagggtgtagggaaatggtaaagaaggcatccttcaggtcaattgcagtgtagagggtggtgttggtagcgacgagagagagaagtggataggggttatggactatgggatgaatagggaggacagcttgactgatggcttggaggttgtgaacgagtcggtatgagccatcagactttttaacagggaggataggggtgttatatggagagtgtgttggtctaagaagactgcatgagcagagcttgtttacgatgggctgtaggcccttttggtgggttagagagatggggtattgaggaacgttgggaaatttggaagagtcttttaactggattctgatggggtcatggtgagcagctacggaagggttaatgagagaggcaggaagtgggtactggggaaaggggtcaggggccggactagcggagaggagcaggaggggactctggttgaagggggcaagaaaaggtgatagaagctttgactttggctaaaaggtctcagcctagaatgggggtggggcaatgaggcatgataaggaaagagtgtgagaaaatggcatcaaacagggaacaagtaagaggtctggtggcaagcggacaagagatgagtccgtcaacccccacaactgagacttgagagggatgagtgggtcctgagagtcgccctgtcgtcgtaccggctcnt

SEQ ID NO: 734080 - DNA, 3555 bp, Homo sapiens
  misc_feature (3554)..(3554): n is a, c, g, or t
gagatggagtcttgctctgtcgcccaggctggagtgcagtggcatcatctctgctcactgcaagctccgcctcccgggttcaccccacacgccattctcctgcctcagcctcctgagtagctgggagtacagctgccggccaccacgcccggctaattttttctatttttagtagagacggggtttcaccgtgttagccaagatggtctcgatctcctgacctcgtgatccgcccgcctcagcctcccaaagatctgggattacaggcgtgagccactgcacccggccagaagctttttcatttattcgtccagcagcatcttgtactagtcctgactggttagtatagaaacagcactcctcttctaaaaagatacacaggccgcctttctcggcagtgaggagatctaaacctcgatggttttgaagtgtcactgctgcttaaagagtcttttggaattggagagcaagtctatttgggattggagaccccttcgtggggttttgggagggcctggtcggcttgttggcagaggagatagctcatgagggagactgttgggaggtattctcctagctgagagttagaagggggcctgttttgtaagaggaaagggcgtccgtatattaactcaaatggactgaggaaggagggtgcttttggactggctctaatgctctccagtgctatgggcaaaagggaggtccatggtttttggacttcaagagtgagtttggttaactgagccttaaggatcccatttgccctttcgacttttccggatgtctggggccagcatgggatatggagacgccactggatgccaagggactgagaaacctgttgagtgatttgggagatgaagctaggggccattgtctgattgtatggagccagggagaccaaatgtagggatgatttctgttacaagaatttgggagacttctgcggccttttctgaagaggtaggaaatgcttctacccacctagagaaggtgtctataagagtaagaataaattttgtcctcttgacgggatgaatgtgggtgaagtctatttgccagtcctcccctgggagtgttcctctgaggggatgtgtagggatggagggagagtggagggccccttgggaggaagtaacagagcatataggacagtttgaggttatgtctcttagtgaggtgaatagatggggggaggagaaatagggtgaaggagtaggtatgggggcgcacactgatatggaaggattggtgaagagatgtcagaatttctttggtctgctcttaggggaggacgagcttttgatttttgactatccagtccccttgaaaggaggctccttgctgtatagcaaagctttctcggtgggagagttcttgggtaggattgctgggataacaggaaggagaggggcagaggcagaagaaagggaggcttcttttgctgcctcatcggcctttctgttgcctcgagatttcatctgaacctgttcgatgtcctcaacagtgtataactcctgctttagctgggaggtgtgtggcctgaaggagttagtaaataaggtggccattagtgataggggttcctttggcagtaaggagtcctctcttttgccagatagcagcgtgggaacgaggaatgtgataggcatatttggagtctgtataaatgttgactcgtttgcctttggaaagatttagggccctggtgagagctatgagttctgctttttgggaggaggatcctggcttcaattacttggtcaagggaaacaactgcatatccagcaatctggggggtagctggtgggcctggaagaggagccatctatgaatagttgatcatcggggttggtgagaggctcggaggaaatgtttgggaaatgtggctgtacgtggtccaggatatcagtggaagaatgagtaggaagggaagaggatacggggagtaaggatgctgggttgagggaagcacttctggtaagactgaatttgggattttttataaagagggcatggagtaattgaatcctggaaggaggaagggagcttactgcttgggaggagaggagatcttgtagattatgagaactgtggacggtggtattctggctgaaagttagtttcctgctttctagagctaagctggctaccacttctagtgctttaaagcaggctggccaccctttgactgtgttatctagttgtttagagaggtaagctacaggggcaaaggaaggaggatttcctttctgttgtcctaagacaccgagggctattcctcagctttcagcagtatagagagtgaaaggttgggagatatcaggtaaggacggagctgacgcagtgacaagagcagtttggagtttgtggaagctggggagtatgttatgtgaggggtttaggggttcattgggagggcctttggccacttcatagaggggatgagctaggagggcaaagttggaaatccatattctaaagaagcctgctagccctgggaaggaaaggatttcgcttttggaggagggtgggggtagattttctattaatgctgccctggctggagtcatagcctgggccccaggggaaagttgaattcctaagtaagtcatcatggagatggagagttgggccttggagggggagaccctataccctttgatagcgagaaagtttaagagagcagtggccgtgtgagtttgagagtcttttagagaggggctgcaaagaagaaggtcgtccacatattgaagatgactgggagacaggtttaaggaagtgaggtttcgggctagagcttgtccaaagaaatgagggctatccctgaagccctgagggaggacagtccatgtgagttgttgtgactggagggtgtcagggtcagtccaggtgaaagcaaataggttttgggaatcagggtgtagggaaatggtaaagaaggcatccttcaggtcaattgcagtgtagagggtggtgttggtagcgacgagagagagaagtggataggggttatggactatgggatgaatagggaggacagcttgactgatggcttggaggttgtgaacgagtcggtatgagccatcagactttttaacagggaggataggggtgttatatggagagtgtgttggtctaagaagactgcatgagcagagcttgtttacgatgggctgtaggcccttttggtgggttagagagatggggtattgaggaacgttgggaaatttggaagagtcttttaactggattctgatggggtcatggtgagcagctacggaagggttaatgagagaggcaggaagtgggtactggggaaaggggtcaggggccggactagcggagaggagcaggaggggactctggttgaagggggcaagaaaaggtgatagaagctttgactttggctaaaaggtctcagcctagaatgggggtggggcaatgaggcatgataaggaaagagtgtgagaaaatggcatcaaacagggaacaagtaagaggtctggtggcaagcggacaagaggtcgccctgtcgtcgtaccggctcnt

SEQ ID NO: 734081 - DNA, 5478 bp, Homo sapiens
gagatggagtcttgctctgtcgcccaggctggagtgcagtggcatcatctctgctcactgcaagctccgcctcccgggttcaccccacacgccattctcctgcctcagcctcctgagtagctgggagtacagctgccggccaccacgcccggctaattttttctatttttagtagagacggggtttcaccgtgttagccaagatggtctcgatctcctgacctcgtgatccgcccgcctcagcctcccaaagatctgggattacaggcgtgagccactgcacccggccagaagctttttcatttattcgtccagcagcatcttgtactagtcctgactggttagtatagaaacagcactcctcttctaaaaagatacacaggccgcctttctcggcagtgaggagatctaaacctcgatggttttgaagtgtcactgctgcttaaagagtcttttggaattggagagcaagtctatttgggattggagaccccttcgtggggttttgggagggcctggtcggcttgttggcagaggagatagctcatgagggagactgttgggaggtattctcctagctgagagttagaagggggcctgttttgtaagaggaaagggcgtccgtatattaactcaaatggactgaggaaggagggtgcttttggactggctctaatgctctccagtgctatgggcaaaagggaggtccatggtttttggacttcaagagtgagtttggttaactgagccttaaggatcccatttgccctttcgacttttccggatgtctggggccagcatgggatatggagacgccactggatgccaagggactgagaaacctgttgagtgatttgggagatgaagctaggggccattgtctgattgtatggagccagggagaccaaatgtagggatgatttctgttacaagaatttgggagacttctgcggccttttctgaagaggtaggaaatgcttctacccacctagagaaggtgtctataagagtaagaataaattttgtcctcttgacgggatgaatgtgggtgaagtctatttgccagtcctcccctgggagtgttcctctgaggggatgtgtagggatggagggagagtggagggccccttgggaggaagtaacagagcatataggacagtttgaggttatgtctcttagtgaggtgaatagatggggggaggagaaatagggtgaaggagtaggtatgggggcgcacactgatatggaaggattggtgaagagatgtcagaatttctttggtctgctcttaggggaggacgagcttttgatttttgactatccagtccccttgaaaggaggctccttgctgtatagcaaagctttctcggtgggagagttcttgggtaggattgctgggataacaggaaggagaggggcagaggcagaagaaagggaggcttcttttgctgcctcatcggcctttctgttgcctcgagatttcatctgaacctgttcgatgtcctcaacagtgtataactcctgctttagctgggaggtgtgtggcctgaaggagttagtaaataaggtggccattagtgataggggttcctttggcagtaaggagtcctctcttttgccagatagcagcgtgggaacgaggaatgtgataggcatatttggagtctgtataaatgttgactcgtttgcctttggaaagatttagggccctggtgagagctatgagttctgctttttgggaggaggatcctggcttcaattacttggtcaagggaaacaactgcatatccagcaatctggggggtagctggtgggcctggaagaggagccatctatgaatagttgatcatcggggttggtgagaggctcggaggaaatgtttgggaaatgtggctgtacgtggtccaggatatcagtggaagaatgagtaggaagggaagaggatacggggagtaaggatgctgggttgagggaagcacttctggtaagactgaatttgggattttttataaagagggcatggagtaattgaatcctggaaggaggaagggagcttactgcttgggaggagaggagatcttgtagattatgagaactgtggacggtggtattctggctgaaagttagtttcctgctttctagagctaagctggctaccacttctagtgctttaaagcaggctggccaccctttgactgtgttatctagttgtttagagaggtaagctacaggggcaaaggaaggaggatttcctttctgttgtcctaagacaccgagggctattcctcagctttcagcagtatagagagtgaaaggttgggagatatcaggtaaggacggagctgacgcagtgacaagagcagtttggagtttgtggaagctggggagtatgttatgtgaggggtttaggggttcattgggagggcctttggccacttcatagaggggatgagctaggagggcaaagttggaaatccatattctaaagaagcctgctagccctgggaaggaaaggatttcgcttttggaggagggtgggggtagattttctattaatgctgccctggctggagtcatagcctgggccccaggggaaagttgaattcctaagtaagtcatcatggagatggagagttgggccttggagggggagaccctataccctttgatagcgagaaagtttaagagagcagtggccgtgtgagtttgagagtcttttagagaggggctgcaaagaagaaggtcgtccacatattgaagatgactgggagacaggtttaaggaagtgaggtttcgggctagagcttgtccaaagaaatgagggctatccctgaagccctgagggaggacagtccatgtgagttgttgtgactggagggtgtcagggtcagtccaggtgaaagcaaataggttttgggaatcagggtgtagggaaatggtaaagaaggcatccttcaggtcaattgcagtgtagagggtggtgttggtagcgacgagagagagaagtggataggggttatggactatgggatgaatagggaggacagcttgactgatggcttggaggttgtgaacgagtcggtatgagccatcagactttttaacagggaggataggggtgttatatggagagtgtgttggtctaagaagactgcatgagcagagcttgtttacgatgggctgtaggcccttttggtgggttagagagatggggtattgaggaacgttgggaaatttggaagagtcttttaactggattctgatggggtcatggtgagcagctacggaagggttaatgagagaggcaggaagtgggtactggggaaaggggtcaggggccggactagcggagaggagcaggaggggactctggttgaagggggcaagaaaaggtgatagaagctttgactttggctaaaaggtctcagcctagaatgggggtggggcaatgaggcatgataaggaaagagtgtgagaaaatggcagtgggggccgggagccggggcccaggggccctggcctcatcagtcttcagtggctaggccaaggagctatgggagtgcaagtgattcttcactttttgtcttgttgaagggatggtggctctgaggagcatgcttgtctgcccatctgttgagaggacagtcagacttccagtgcccatctgctggcagactaggcaagggctcttcggcactcatgggtggggacatgcccccgtccagtggccttctttgccgcacttaaaacaaggcccaggaggtttgctgctatcaggtcttttgtgcccttgggtactatggctagactgacagatagccactgctggaagctggtatttagcacgatctctttgggctttatctaatttattttgctcgtccctgttattaaagactttgaaagccaggttaaggaggtcttgttgtggggtttgagagccatcttcagcctttttaagtttgtgccggatgtcaggggcagattgggaaataaaatgggtattaagaacaatagttcctacatatgtaacaaacctgcacattgtgcacatgtaccctaaaacttaaagtataataataattaaaaaataaataaaattttttaaagaaagaacaatagttccttctcaggaggcagggtcgatgcgggtatatttttggagagcttctgtaaggcgggaaagagattgggcaggattttcatctgccttttgggaaatgtctttaagtttttcaaaatttacagcctatgggcagctttgttaaggcctgcaatgaggcaagtaatcatatggctacagtacacttggccaggttctgtgggttggtattcccaggaaggctcttcccagggaacagcagcagctcctacgggcttagtaggatcctgctgatgaaggtcatcggcatatgcctgtgctgcgagccacactctttccttctcttctggaaggagggtagaagagaggataaagtagagatcatgccaagtgagttcataagattgagtaagatatttaaattctttgatgtaagtatcaggatcggaggagaaggacccgagacgttcttcaatctgtaagagatcgtagaaggagaaagggacgtggacatggacgatcccctcaactcccgctacttcccggagaggaagcaagggagctggttgctgagcacattgggcccgagagcgggtgaggggaggaggcagagaggactcagagtcagaagtgggttggttggagagagtgggggagaggggtagagccggagcagggacatacggtggaggatcatgatgctctggtggaggatcatgatgctgtcgaggagggagaaaatccacggggtcaaaggaagaggagtcatcggctgggtctgtgggtggggtgacgggagatgagtcaggttttgagctggtgagtaggatttggaaagtagagcaggagtggcagagagaagggtggttacggagaatgaagaaagcctgaatataaggaatctcagaccatttctcattgcgatggcaaaagttgtctaagtctctaagtatattgaaatcgaaagtgccattttcgggccattgggagccattgtccaattggtattgaggccatgcagtattgcagtaaaagataagcctcttagaacggatccctgaacggaggccgagagccttgcgattgcggaggagacacccaaggggggtggtcttgggaggggtagactgagaggctcccatagtgaatggaggaggtgagggtagaggaagaagggaccacagacgacaaagacgagagagggcggcgcctgtcttgcaggccttgtatggaatagaggaggtagctgcggagtcaggcgtccaggaaacagaggaaccagaggcctggaggccagaggaagcccttggcccagcgctgggtcttttgggagtgaagagatggtcaagggttccaggtaataggcaaaagtctctc

SEQ ID NO: 734082 - DNA, 1018 bp, Homo sapiens
tggcgacgagtcagtatttcgacttcgcgcagggcggcggcccgcagtacagcaccctcctggaggacgggactttggtctggttattccccgctgctgtgacagcgcccatgacagcagctggtccccactggcacccaggaagtatttatccaatgactcaatgaatctgccgccggatcgcccgggactgctttcactttctgtcagtccagaagtggagaccactcccccggcccttgcatctgggcttccttgtgccctgccttggacagttggctgcagtggaagtgacgctgtgactgccctgtgcccaagcttaagaggccttgcctgcatctgctccatcttatgggaccctgcctggtgaaggacccaaggctggcctgctggaggaggagatataaggagaagagtcacagtgccccatccaacaggtagctgccctccaggggcagagaagcccagccatggtcaggagagccacccagctgaggcccacctccaccaggattgccacccagctgaaccccacctcagccgggagagccacccagctgagccccatctggccaggagagccatccagctgagccccacctctgccaggattgccacccagctgagccccgccttggccaggagagccacccagctgagccccgccttggccagaagagccacccagctgagccccgccttggccagaagagccacccagctgagcaccgccttggccagaagaggcacccagctgagccccgcctggccaggagagctgcccagctgatccccgcctgcagaatcacaagtgaaataaatgattgttgctttgagtcagaggtcagcggaccttttctgtaaaaagccacatagtaaatatctttggctttgtgagccacaccatgtctgtcacattagtgaaccctgctattgtattgcaagatgagccgtggacaatgtgtcatccagtgggcttggctgtgtgccaataaaactttatttttttggacactga

SEQ ID NO: 734083 - DNA, 863 bp, Homo sapiens
cttcatccacccttatatccatgcccttcccaccatgtccttgctactcttccagtccagaagtggagaccactcccccggcccttgcatctgggcttccttgtgccctgccttggacagttggctgcagtggaagtgacgctgtgactgccctgtgcccaagcttaagaggccttgcctgcatctgctccatcttatgggaccctgcctggtgaaggacccaaggctggcctgctggaggaggagatataaggagaagagtcacagtgccccatccaacaggtagctgccctccaggggcagagaagcccagccatggtcaggagagccacccagctgaggcccacctccaccaggattgccacccagctgaaccccacctcagccgggagagccacccagctgagccccatctggccaggagagccatccagctgagccccacctctgccaggattgccacccagctgagccccgccttggccaggagagccacccagctgagccccgccttggccagaagagccacccagctgagccccgccttggccagaagagccacccagctgagcaccgccttggccagaagaggcacccagctgagccccgcctggccaggagagctgcccagctgatccccgcctgcagaatcacaagtgaaataaatgattgttgctttgagtcagaggtcagcggaccttttctgtaaaaagccacatagtaaatatctttggctttgtgagccacaccatgtctgtcacattagtgaaccctgctattgtattgcaagatgagccgtggacaatgtgtcatccagtgggcttggctgtgtgccaataaaactttatttttttggacactga

SEQ ID NO: 734084 - DNA, 2453 bp, Homo sapiens; identical to SEQ ID NO: 29723

SEQ ID NO: 734085 - DNA, 852 bp, Homo sapiens
tgctgaaggttctgggctgcaaagctgaagctttggtttctgctctaaatgaaggacttttccaggacccaaggccacacactggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccaaggaggaagaggaagatgagcaggaggccagcgaggagaaggccagtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaag

SEQ ID NO: 734086 - DNA, 790 bp, Homo sapiens
gttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgcgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagttagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaa

SEQ ID NO: 734087 - DNA, 558 bp, Homo sapiens
tgctgaaggttctgggctgcaaagctgaagctttggtttctgctctaaatgaaggacttttccaggacccaaggccacacactggaagtcttgcagctgaagggaggcactccttggcctccgcagccgatcacatgaaggtggtgccaagtctcctgctctccgtcctcctggcacagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccaggagatgcatgagctgcttaggcagatgggaatcagaagaatcttctcaccctttgctgaccttagtgaactctcagctactggaagaaatctccaagtatccagg

SEQ ID NO: 734088 - DNA, 412 bp, Homo sapiens; identical to SEQ ID NO: 29727

SEQ ID NO: 734089 - DNA, 744 bp, Homo sapiens
  misc_feature (3)..(3): n is a, c, g, or t
  misc_feature (7)..(8): n is a, c, g, or t
  misc_feature (10)..(10): n is a, c, g, or t
ttngtannangggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattg

SEQ ID NO: 734090 - DNA, 943 bp, Homo sapiens
  misc_feature (3)..(3): n is a, c, g, or t
  misc_feature (7)..(8): n is a, c, g, or t
  misc_feature (10)..(10): n is a, c, g, or t
ttngtannangggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccaggtaaggaggggaaggatacttatgtgtgtgtgtggagtgtggagatgatagtggtggtggaacttgaaagctagattcagtcctgaggaatggttcctctgttctgagtctacagcatctgcggaatggaatgatcactcttccaaggtgtgcagcagggtgtcaacactttcatatctgaatgtctttgcccttacagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattg

SEQ ID NO: 734091 - DNA, 884 bp, Homo sapiens
  misc_feature (3)..(3): n is a, c, g, or t
  misc_feature (7)..(8): n is a, c, g, or t
  misc_feature (10)..(10): n is a, c, g, or t
ttngtannangggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccaggtaaggaggggaaggatacttatgtgtgtgtgtggagtgtggagatgatagtggtggtggaacttgaaagctagattcagtcctgaggaatggttcctctgttctgagtctacagcatctgcggaatggaatgatcactcttccaaggtgtgcagcagggtgtcaacactttcatatctgaatgtctttgcccttacagatagatggctccccaataccagaagtgagttcggcaaagagaaggccacggagaatgaccccattttggagaggggtttccctcaggcctattggagcctcctgccgggatgattctgagtgtatcacaaggctatgcaggtactccctgaacctgggagcagggttgggccagagagccctgggaagctgggcagaggagtgacaaggggacacatgaacctaagaataaagctgggatggaggagttctagactgagactgggagctccatggaaaatcccttaggagttaggagccaagaacagctctatgtgggtaccatgaaagaaggaaggaaatgcagcataggtggccctggtcattcc

SEQ ID NO: 734092 - DNA, 1028 bp, Homo sapiens
  misc_feature (3)..(3): n is a, c, g, or t
  misc_feature (7)..(8): n is a, c, g, or t
  misc_feature (10)..(10): n is a, c, g, or t
ttngtannangggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattgaaattttagcagtctggaattcaagcttttgagggaaagaaggattcattttgtatactaaagaaaagctacataatcaatagctacgtaatcaacttcagcaagttcctaagctgtggccctggatcccttcactccatactcttcagggaggtgtcaaaggtggtcaagcttgggaggctgaggcaggagaatcacttgaacctgggaggtggaggttgcagtgagccaagatcatgccactgcaccccagcctgggtgacatagagagactctgtctcaaa

SEQ ID NO: 734093 - DNA, 1082 bp, Homo sapiens
  misc_feature (3)..(3): n is a, c, g, or t
  misc_feature (7)..(8): n is a, c, g, or t
  misc_feature (10)..(10): n is a, c, g, or t
ttngtannangggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattgaaattttagcagtctggaattcaagcttttgagggaaagaaggattcattttgtatactaaagaaaaaaacagcattgcccaataatgtgttaacttctcaatctggaaagtgtagtgagagctacataatcaatagctacgtaatcaacttcagcaagttcctaagctgtggccctggatcccttcactccatactcttcagggaggtgtcaaaggtggtcaagcttgggaggctgaggcaggagaatcacttgaacctgggaggtggaggttgcagtgagccaagatcatgccactgcaccccagcctgggtgacatagagagactctgtctcaaa

SEQ ID NO: 734094 - DNA, 1027 bp, Homo sapiens
  misc_feature (3)..(3): n is a, c, g, or t
  misc_feature (7)..(8): n is a, c, g, or t
  misc_feature (10)..(10): n is a, c, g, or t
ttngtannangggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccagatagatggctccccaataccagaagtgagttcggcaaagagaaggccacggagaatgaccccattttggagaggggtttccctcaggcctattggagcctcctgccgggatgattctgagtgtatcacaaggctatgcagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattgaaattttagcagtctggaattcaagcttttgagggaaagaaggattcattttgtatactaaagaaaaaaacagcattgcccaataatgtgttaacttctcaatctggaaagtgtagtgagagctacataatcaatagctacgtaatcaacttcagcaagttcctaagctgtggccctggatcccttcactccatactcttcagggaggtgtcaaaggtggtcaagcttgggaggctgaggcaggagaatcacttgaacctgggaggtggaggttgcagtgagccaagatcatgccactgcaccccagcctgggtgacatagagagactctgtctcaaa

SEQ ID NO: 734095 - DNA, 973 bp, Homo sapiens
  misc_feature (3)..(3): n is a, c, g, or t
  misc_feature (7)..(8): n is a, c, g, or t
  misc_feature (10)..(10): n is a, c, g, or t
ttngtannangggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccagatagatggctccccaataccagaagtgagttcggcaaagagaaggccacggagaatgaccccattttggagaggggtttccctcaggcctattggagcctcctgccgggatgattctgagtgtatcacaaggctatgcagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattgaaattttagcagtctggaattcaagcttttgagggaaagaaggattcattttgtatactaaagaaaagctacataatcaatagctacgtaatcaacttcagcaagttcctaagctgtggccctggatcccttcactccatactcttcagggaggtgtcaaaggtggtcaagcttgggaggctgaggcaggagaatcacttgaacctgggaggtggaggttgcagtgagccaagatcatgccactgcaccccagcctgggtgacatagagagactctgtctcaaa

SEQ ID NO: 734096 - DNA, 1227 bp, Homo sapiens
  misc_feature (3)..(3): n is a, c, g, or t
  misc_feature (7)..(8): n is a, c, g, or t
  misc_feature (10)..(10): n is a, c, g, or t
ttngtannangggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccaggtaaggaggggaaggatacttatgtgtgtgtgtggagtgtggagatgatagtggtggtggaacttgaaagctagattcagtcctgaggaatggttcctctgttctgagtctacagcatctgcggaatggaatgatcactcttccaaggtgtgcagcagggtgtcaacactttcatatctgaatgtctttgcccttacagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattgaaattttagcagtctggaattcaagcttttgagggaaagaaggattcattttgtatactaaagaaaagctacataatcaatagctacgtaatcaacttcagcaagttcctaagctgtggccctggatcccttcactccatactcttcagggaggtgtcaaaggtggtcaagcttgggaggctgaggcaggagaatcacttgaacctgggaggtggaggttgcagtgagccaagatcatgccactgcaccccagcctgggtgacatagagagactctgtctcaaa

SEQ ID NO: 734097 - DNA, 1281 bp, Homo sapiens
  misc_feature (3)..(3): n is a, c, g, or t
  misc_feature (7)..(8): n is a, c, g, or t
  misc_feature (10)..(10): n is a, c, g, or t
ttngtannangggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccaggtaaggaggggaaggatacttatgtgtgtgtgtggagtgtggagatgatagtggtggtggaacttgaaagctagattcagtcctgaggaatggttcctctgttctgagtctacagcatctgcggaatggaatgatcactcttccaaggtgtgcagcagggtgtcaacactttcatatctgaatgtctttgcccttacagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattgaaattttagcagtctggaattcaagcttttgagggaaagaaggattcattttgtatactaaagaaaaaaacagcattgcccaataatgtgttaacttctcaatctggaaagtgtagtgagagctacataatcaatagctacgtaatcaacttcagcaagttcctaagctgtggccctggatcccttcactccatactcttcagggaggtgtcaaaggtggtcaagcttgggaggctgaggcaggagaatcacttgaacctgggaggtggaggttgcagtgagccaagatcatgccactgcaccccagcctgggtgacatagagagactctgtctcaaa

SEQ ID NO: 734098 - DNA, 496 bp, Homo sapiens
gttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactccgatgtgctggcagttgcaggctttgccctgcgggatattaacaaagacagaaaggatggctatgtgctgagactcaaccgagtgaacgacgcccaggaatacagacggtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccag

SEQ ID NO: 734099 - DNA, 1635 bp, Homo sapiens; identical to SEQ ID NO: 56954
  misc_feature (701)..(701): n is a, c, g, or t
  misc_feature (719)..(719): n is a, c, g, or t
  misc_feature (728)..(728): n is a, c, g, or t

SEQ ID NO: 734100 - DNA, 1568 bp, Homo sapiens
  misc_feature (701)..(701): n is a, c, g, or t
  misc_feature (719)..(719): n is a, c, g, or t
  misc_feature (728)..(728): n is a, c, g, or t
gttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactccgatgtgctggcagttgcaggctttgccctgcgggatattaacaaagacagaaaggatggctatgtgctgagactcaaccgagtgaacgacgcccaggaatacagacggggtggcctgggatctctgttctatcttacactggatgtgctagagactgactgccatgtgctcagaaagaaggcatggcaagactgtggaatgaggatattttttgaatcagtttatggtcaatgcaaagcaatattttatatgaacaacccaagtagagttctctatttagctgcttataactgtactcttcgcccagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtngtcggcccttcttacttngtggaatanttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggttgtcctgcctttcccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgaccctcggcttgggctgcactctaccctgtacactgccttgtaccctgagctgcatcacctcctaaactgagcagtctcataccatggagagatgcctctcttatgtcttcagccactcacttataaagatacttatcttttcagcagta

SEQ ID NO: 734101 - DNA, 629 bp, Homo sapiens
gttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactccgatgtgctggcagttgcaggctttgccctgcgggatattaacaaagacagaaaggatggctatgtgctgagactcaaccgagtgaacgacgcccaggaatacagacggggtggcctgggatctctgttctatcttacactggatgtgctagagactgactgccatgtgctcagaaagaaggcatggcaagactgtggaatgaggatattttttgaatcagtttatggtcaatgcaaagcaatattttatatgaacaacccaagtagagttctctatttagctgcttataactgtactcttcgcccagatcaccaagtgctggaggctgccaccgagtctcttgcgaaatacaacaatgagaacacatccaagcagtattctctcttcaaagtcaccagggcttctagccag

SEQ ID NO: 734102 - DNA, 281 bp, Homo sapiens
cagtctccagtacaaattaacaaaccggctgctggcttatgtatcagttgcctatgcatagggtcagtatactcacccccaggcctgaacaactctgggtcctcaggaaccctgaaggtgtgactggcaaagctgaggccctggctcgggagctgcttccctgagaggactgcgcctacagcatccttgacatcttttcataaaccagcacaacttttcaaaaaaaaagatttacatgacgtgccctgactgcccaagctccatacccactgactcttcca

SEQ ID NO: 734103 - DNA, 1317 bp, Homo sapiens
  misc_feature (701)..(701): n is a, c, g, or t
  misc_feature (719)..(719): n is a, c, g, or t
  misc_feature (728)..(728): n is a, c, g, or t
gttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactccgatgtgctggcagttgcaggctttgccctgcgggatattaacaaagacagaaaggatggctatgtgctgagactcaaccgagtgaacgacgcccaggaatacagacggggtggcctgggatctctgttctatcttacactggatgtgctagagactgactgccatgtgctcagaaagaaggcatggcaagactgtggaatgaggatattttttgaatcagtttatggtcaatgcaaagcaatattttatatgaacaacccaagtagagttctctatttagctgcttataactgtactcttcgcccagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtngtcggcccttcttacttngtggaatanttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgaccctcggcttgggctgcactctaccctgtacactgccttgtaccctgagctgcatcacctcctaaactgagcagtctcataccatggagagatgcctctcttatgtcttcagccactcacttataaagatacttatcttttcagcagta

SEQ ID NO: 734104 - DNA, 3568 bp, Homo sapiens; identical to SEQ ID NO: 92315

SEQ ID NO: 734105 - DNA, 458 bp, Homo sapiens; identical to SEQ ID NO: 92312

SEQ ID NO: 734106 - DNA, 3262 bp, Homo sapiens
gccaagggctcagaggcttacagggcccccctggaaagttggggcctccaggaaatccagggccttctgggtcaccaggaccaaagggccaaaaaggagaccctggaaaaagtccggatggtgatagtagcctggctgcctcagaaagaaaagctctgcaaacagaaatggcacgtatcaaaaagtggctgaccttctctctgggcaaacaagttgggaacaagttcttcctgaccaatggtgaaataatgacctttgatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaaaaatgatcactaacagcaccaacaaagcaataatagtagtagtagtagttagcagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgcttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcaatgttttcagttctcttgattttcattattcctgtggatgtaaagtgatatttccccatggttttaatctgtatttccccaacatgtaataaggttgaacacttttttatatgcttattgggcacttgggtatcttcttctgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatgtaggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactgtagtccagctttgttcttcttcaagtcaagatttccatataaatattagaaacagtttctcaatttctacaaaatcctgatgaggtttctactgggaccacattgagtctatcaatcaacttatgcagaactggcaacttactactgaatctctaatcaatgttcatcatgtatcgcttcatttaactaggatttctttaacttaattgctatgttttgacatttttagtttaaaaaccttgtatatcttgttttggtggttttagtgattttaataatatattttaaatattttttcttttctattgttgtacacagaaatacagttaagttttgtgtgtagtcttacgatgtttagtaacctcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagatcaggtatagactcctgaaagacaatataatgaagtgctccagtcaggcctatctaaactggattcacagctctgtcacttaattgctacatgatctagagccagttactttgtgtttcagccatgtatttgcagctgagagaaaataatcattcttatttcatgaaaattgtggggatgatgaaataagttaacacctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcac

SEQ ID NO: 734107 - DNA, 3514 bp, Homo sapiens; identical to SEQ ID NO: 92316

SEQ ID NO: 734108 - DNA, 3514 bp, Homo sapiens; identical to SEQ ID NO: 92313

SEQ ID NO: 734109 - DNA, 3460 bp, Homo sapiens
ggtaaatatgtgttcattaactgagattaaccttccctgagttttctcacaccaaggtgaggaccatgtccctgtttccatcactccctctccttctcctgagtatggtggcagcgtcttactcagaaactgtgacctgtgaggatgcccaaaagacctgccctgcagtgattgcctgtagctctccaggcatcaacggcttcccaggcaaagatgggcgtgatggcaccaagggagaaaagggggaaccaggccaagggctcagaggcttacagggcccccctggaaagttggggcctccaggaaatccagggccttctgggtcaccaggaccaaagggccaaaaaggagaccctggaaaaagtccggatggtgatagtagcctggctgcctcagaaagaaaagctctgcaaacagaaatggcacgtatcaaaaagtggctgaccttctctctgggcaaacaagttgggaacaagttcttcctgaccaatggtgaaataatgacctttgaaaaagtgaaggccttgtgtgtcaagttccaggcctctgtggccacccccaggaatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgcttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcaatgttttcagttctcttgattttcattattcctgtggatgtaaagtgatatttccccatggttttaatctgtatttccccaacatgtaataaggttgaacacttttttatatgcttattgggcacttgggtatcttcttctgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatgtaggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactgtagtccagctttgttcttcttcaagtcaagatttccatataaatattagaaacagtttctcaatttctacaaaatcctgatgaggtttctactgggaccacattgagtctatcaatcaacttatgcagaactggcaacttactactgaatctctaatcaatgttcatcatgtatcgcttcatttaactaggatttctttaacttaattgctatgttttgacatttttagtttaaaaaccttgtatatcttgttttggtggttttagtgattttaataatatattttaaatattttttcttttctattgttgtacacagaaatacagttaagttttgtgtgtagtcttacgatgtttagtaacctcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagatcaggtatagactcctgaaagacaatataatgaagtgctccagtcaggcctatctaaactggattcacagctctgtcacttaattgctacatgatctagagccagttactttgtgtttcagccatgtatttgcagctgagagcctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcac

SEQ ID NO: 734110 - DNA, 3208 bp, Homo sapiens
gccaagggctcagaggcttacagggcccccctggaaagttggggcctccaggaaatccagggccttctgggtcaccaggaccaaagggccaaaaaggagaccctggaaaaagtccggatggtgatagtagcctggctgcctcagaaagaaaagctctgcaaacagaaatggcacgtatcaaaaagtggctgaccttctctctgggcaaacaagttgggaacaagttcttcctgaccaatggtgaaataatgacctttgatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaaaaatgatcactaacagcaccaacaaagcaataatagtagtagtagtagttagcagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgcttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcaatgttttcagttctcttgattttcattattcctgtggatgtaaagtgatatttccccatggttttaatctgtatttccccaacatgtaataaggttgaacacttttttatatgcttattgggcacttgggtatcttcttctgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatgtaggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactgtagtccagctttgttcttcttcaagtcaagatttccatataaatattagaaacagtttctcaatttctacaaaatcctgatgaggtttctactgggaccacattgagtctatcaatcaacttatgcagaactggcaacttactactgaatctctaatcaatgttcatcatgtatcgcttcatttaactaggatttctttaacttaattgctatgttttgacatttttagtttaaaaaccttgtatatcttgttttggtggttttagtgattttaataatatattttaaatattttttcttttctattgttgtacacagaaatacagttaagttttgtgtgtagtcttacgatgtttagtaacctcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagatcaggtatagactcctgaaagacaatataatgaagtgctccagtcaggcctatctaaactggattcacagctctgtcacttaattgctacatgatctagagccagttactttgtgtttcagccatgtatttgcagctgagagcctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcac

SEQ ID NO: 734111 - DNA, 3208 bp, Homo sapiens
gccaagggctcagaggcttacagggcccccctggaaagttggggcctccaggaaatccagggccttctgggtcaccaggaccaaagggccaaaaaggagaccctggaaaaagtccggatggtgatagtagcctggctgcctcagaaagaaaagctctgcaaacagaaatggcacgtatcaaaaagtggctgaccttctctctgggcaaacaagttgggaacaagttcttcctgaccaatggtgaaataatgacctttgatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgcttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcaatgttttcagttctcttgattttcattattcctgtggatgtaaagtgatatttccccatggttttaatctgtatttccccaacatgtaataaggttgaacacttttttatatgcttattgggcacttgggtatcttcttctgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatgtaggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactgtagtccagctttgttcttcttcaagtcaagatttccatataaatattagaaacagtttctcaatttctacaaaatcctgatgaggtttctactgggaccacattgagtctatcaatcaacttatgcagaactggcaacttactactgaatctctaatcaatgttcatcatgtatcgcttcatttaactaggatttctttaacttaattgctatgttttgacatttttagtttaaaaaccttgtatatcttgttttggtggttttagtgattttaataatatattttaaatattttttcttttctattgttgtacacagaaatacagttaagttttgtgtgtagtcttacgatgtttagtaacctcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagatcaggtatagactcctgaaagacaatataatgaagtgctccagtcaggcctatctaaactggattcacagctctgtcacttaattgctacatgatctagagccagttactttgtgtttcagccatgtatttgcagctgagagaaaataatcattcttatttcatgaaaattgtggggatgatgaaataagttaacacctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcac

SEQ ID NO: 734112 - DNA, 3154 bp, Homo sapiens
gccaagggctcagaggcttacagggcccccctggaaagttggggcctccaggaaatccagggccttctgggtcaccaggaccaaagggccaaaaaggagaccctggaaaaagtccggatggtgatagtagcctggctgcctcagaaagaaaagctctgcaaacagaaatggcacgtatcaaaaagtggctgaccttctctctgggcaaacaagttgggaacaagttcttcctgaccaatggtgaaataatgacctttgatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgcttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcaatgttttcagttctcttgattttcattattcctgtggatgtaaagtgatatttccccatggttttaatctgtatttccccaacatgtaataaggttgaacacttttttatatgcttattgggcacttgggtatcttcttctgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatgtaggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactgtagtccagctttgttcttcttcaagtcaagatttccatataaatattagaaacagtttctcaatttctacaaaatcctgatgaggtttctactgggaccacattgagtctatcaatcaacttatgcagaactggcaacttactactgaatctctaatcaatgttcatcatgtatcgcttcatttaactaggatttctttaacttaattgctatgttttgacatttttagtttaaaaaccttgtatatcttgttttggtggttttagtgattttaataatatattttaaatattttttcttttctattgttgtacacagaaatacagttaagttttgtgtgtagtcttacgatgtttagtaacctcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagatcaggtatagactcctgaaagacaatataatgaagtgctccagtcaggcctatctaaactggattcacagctctgtcacttaattgctacatgatctagagccagttactttgtgtttcagccatgtatttgcagctgagagcctttaaagtgtgtagtaaagtatcaggatactatattttaggtcttaatacacacagttatgccgctagatacatgctttttaatgagataatgtgatattatacataacacatatcgatttttaaaaattaaatcaaccttgctttgatggaataaactccatttagtcac

SEQ ID NO: 734113 - DNA, 797 bp, Homo sapiens
aaaatatttaagggcctaccacatcagtgaagattttaaggctcagtgttgtaccttgaacaacctatcattaaaaaagaggtgcaaaactgtgcccaaaattcatgaccccagaagcttaaattttggaggcagcatttacttcacttgacaacgatatattcagttgctttataggctgactcacagataccagtttagagtggtatctagagcaaaaataaataataaataaatatgctctgcagcaagtttaaactttgatttaagctgtcctttattttggccatatcacctggcaggtcctatggaattacagaggtcatggtaggttaattatgctgagcatcgtctctagtaagtcccagggagagagatgctgggtagaccagtaggcttctgaaacaaagccatgccctctatagcagagaactttattatttatttatttatttatggctctttaaagatctagaagaccatcaactttatttgaatcatatgtcaaacacacacacacacacacacacacacacacacacacccctacaaaacaatctgagaaatctgaacattgactggatatttgacagccttaggaatgattattaaagatgtgatcatagaattgtgattacatttttattcaacaggtttttggggaacaggtggtgtttggtgatgttaataagttatttattggtgatttctgagattttaatgcttccatcacccgagcagtgtacccgtacccaatgcatagtcttttatccctcaccccatttcccacactttct

SEQ ID NO: 734114 - DNA, 808 bp, Homo sapiens; identical to SEQ ID NO: 33589

SEQ ID NO: 734115 - DNA, 906 bp, Homo sapiens
aatgttgctttatataataggtctgtttctcttaagtgtgcaaaataaatttttgtaaattgagctatacttaagatattgttaaagaaccatgaagtggctctttgtgtaatttgctgtgtaaaaatcttaatctgatttcttataagtttttctgcattttaactgcaacctgttcatcataatctaatagatagtggtttaagagcatagaatctgtagtcagactgcctgggttcaaatccaggctcttccatttagctaccagctttatgcttggttgtagatcctgttaagtaggaataatagtagttactttaaaaggttattgagaaaatctagagagttaatgcataaaaagtgtttagaatcatgcatggccccttacaggtatttcttacatgtttggggctatcattacctagcatgggatttgtttaggacattgtgctagataatagagatccaaggagggtctgtagccaggttgctgcccacaagaggcttgtgggaacatagtttggttaaatcttacaaggacattggaagccttactctttttaagtggggatcatcccacacgccttaaatgctgccttgtccggttatcctcttgcaccaggagtgaggaaggagtgaattgggtggtggggtaaagatggccaccttggttcacacccccttcctctgctatatctttgcagtatgacttctctttggaaaagaaaaccattgagtgggctgaagagattaagaaaatcgaagaagccgagcgggaagcagagtgcaaaattgcggaagcagaagctaaagtgaattctaagagtgccagagggcgatagcaaaatgagcttctccaagactcacagtacagccacaatgccacctcctattaaccccatccac

SEQ ID NO: 734116 - DNA, 574 bp, Homo sapiens; identical to SEQ ID NO: 728859

SEQ ID NO: 734117 - DNA, 433 bp, Homo sapiens
ggtcggtccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgcccaggccaagttgtcctgaagtcgggctctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctgggccctccgatgacatcttgcaggccccaaatggcttccggtcggtggggttcctctaggcccagcttggg

SEQ ID NO: 734118 - DNA, 1556 bp, Homo sapiens
ctttcaatagaaatgtcttcttgccttaggaaaataaagggctaggaaaggtcactgcgttgataaaaaccaatagacgacagggacaaaagtgagatcagataggaggagaacaaccagactgaagactcaacataagctgttattggtaagtgactcaaaggggagttttgaaaattaccaggatgtttaatagtcaggtctcaaagactgagtatgttgtatgggctaaaggaagcctaaagaatcatttcgttgtatggaagagatgaatgaacctggacagtagggataagtaagacaggagcctaatcttttggagatgaaagctcctgcttctgcaaaaatcccttctgaagtgtggaaacgcatctaggaccagggttctcaacacctagaccatgacttctaggtcactgatgccatggtaacaaaaccaagtaaatctaagctcatttgagaattttagatcctcttatgttaacaatgtgactttgaaaaataaaagcagaccatgggaatgagtccagatgggcagctttgcaggagtgtagacatgtggtattctgttgaagaaagagagggtcgttgagggagagttgaatgtcttgcaaaggcagagttccacacaatggatttagggtttctcagtgagtcctttctaaatgcttgttatatcctggtcataatgcatatgggttcactgagtcctctggtcactttccactggggatttttatctgagctcccgagtcagagctgggcatagactctggttcttcatgaggagtgctgtatttgctctgtaacctgggagacatttgttccctagtcgtgcagcacatggtattgtgtttcctgacctaggcaagtgcccatgctcagtacagaaccataagttggtagcagcttctcctttctggccaaatgatgggccctgtccctctgatgagtgcatttcatgttgtgtttccaattttcatcagcaatgttcgtcattccctggtcctttgaaagactgtgtagcccgcggttatggagccgggatgaatctgatgatcatcatcttctccaataacagatgccatttttaacttcaatatgctgtctggacatagtgagaactaatggcaataaacgtccagctgcatggtgcacctcttttttataggggtgccctgctgtctttgtaaaccctcctctggcctctgagcatctattataattgtgtagaaagtacatctctatattgtaaataagagtgtcgagtgttgcgtgtcatgcctcatttgaaaaggtcttttttatgtctctttctattgaaatatagatatcgaatatataaatatatatacataaaatatatataaatatatattatgtaaaacagggacattctattattgattgtaaaaattataaacaaaatgcctgccaagataatggtcttgtatgtcttcattctctgcgtaatttttgtttttgtttttatgatttgttgtttcccaaaatgagttagaaataaaaatgcccaatattgagattaattggaattt

SEQ ID NO: 734119 - DNA, 562 bp, Homo sapiens; identical to SEQ ID NO: 382548

SEQ ID NO: 734120 - DNA, 735 bp, Homo sapiens; identical to SEQ ID NO: 382549

SEQ ID NO: 734121 - DNA, 464 bp, Homo sapiens; identical to SEQ ID NO: 382550

SEQ ID NO: 734122 - DNA, 395 bp, Homo sapiens
tgagatgaacccggtacctcagatggaaatgctgaaatcacccgtcttctgcgtcgctcaggctgggagctgtagaccggagctgttcctattcggccatcttgtctcctccccccagcccacaacagcctatgaagaataactagaggtcttcatatcagaggcagaaggtactgcaagcttactttccaacgtggctgcatcgtttcacattcccaccagcagtatgaggtttccaatttctctgcatcctcatcaaaacttgttattatctgtcttttttattttagacgttctagaaggtgtggagtggtatctcattgtggtattgatttgcatttccttaaggactaatgcttttgaacattttttcatgtgcttattggccatttgtg

SEQ ID NO: 734123 - DNA, 464 bp, Homo sapiens; identical to SEQ ID NO: 382551

SEQ ID NO: 734124 - DNA, 368 bp, Homo sapiens
tgagatgaacccggtacctcagatggaaatgctgaaatcacccgtcttctgcgtcgctcaggctgggagctgtagaccggagctgttcctattcggccatcttgtctcctccccccaggtgatggccacagtggcagaacctaggaagccaagaagaaaccagagaatggagacacatggcagcaatggcaagtcatcagacccaggatttcccaaagaacactggtccaggaagatgctctgtgaaaaagtgttccctggtcggagaaatttgtgaaacactttgcataatacttaaaagaatgtatggcacatcaaaggtaatatgcaataaaagaattcatttttttaaaaccaagaatatgcac

SEQ ID NO: 734125 - DNA, 845 bp, Homo sapiens; identical to SEQ ID NO: 382553

SEQ ID NO: 734126 - DNA, 679 bp, Homo sapiens
gtttgtttttcctctctgtcatacctcaagaggaacacaaagagtgatggcctgtcactctgatgcctctctctactcaaatggcagaaaccaaccaggtacatcccagccttcttgcacatagaaacactacacagcacttcagctgtatgtttgggggccattttaaacagcaaaatcatcaacaggaagcagaaaattgtaaaaattgtggcactaaatagaccatgtaaaggacacatgtttgcaataagaaagctgaaacaagaagggggagtgtcaccttatttgatccagctagaaactcaggtgctggtattccagcaacactcaggcggctgctccaggaggctgcagaggggtcctttttagccgtcaacaaaactggctatggtcacgcccattgggaaactcattgctgccttcaaggtgatggccacagtggcagaacctaggaagccaagaagaaaccagagaatggagacacatggcagcaatggcaagtcatcagacccaggatttcccaaagaacactggtccaggaagatgctctgtgaaaaagtgttccctggtcggagaaatttgtgaaacactttgcataatacttaaaagaatgtatggcacatcaaaggtaatatgcaataaaagaattcatttttttaaaaccaagaatatgcac

SEQ ID NO: 734127 - DNA, 722 bp, Homo sapiens
aaaatcccaagcagaaaattcagtcattcaagagaaaagtcattaaagaaaaaggaaaaaatagagaacagaaaagcagacatttagtttttccttaggcgtgacaaagcttaacaaacagtcagttctgcagaaatgctcccagttttcctggtgtcccaagccctcgctctgtttggagactaccacagcctctgtacttctcagctttgtgggtctgggaggcacttttgcttcggaattggggtgaaggctttctaggtcctgattaacagaatctgaactgctcccacctgtcttccctgcagtcctccacccagcagccagggggaattgctttaaaactccaagcagatcatgtcgtctcttggttaaactcttcagtggcttccatgcgaacttctcacctgggttctctgtgctttggtggggcctacctctgagcccagagcttacactccctcctctcaacacactccactcttggttccttgaatgaactaagttcatcccctccttagggcttccagaacattctgtcccatatcttcacatggtttcttcttaccattcaggtctcacctcaaaaatcacttcttccagctgggcgtggtggctcacacctataatcccagcactttgggaggctgaggcaggaagatcgcttgaggccaggagttggagaccaatctggtcaacatagtgagagcccacctctacaa

SEQ ID NO: 734128 - DNA, 967 bp, Homo sapiens
gaaagaaggaaagaaagaaagaaaagaaaagaaataacaagatatagtgagtcagtagattcacttcacaattgtggtactaaataactaaatataagctatctacatataatagtaagaaaaagtttgaagaaaattatataacactttaaaatcaatcataatagactatttatgtagttataggtccctagcaagtttctggataggaagattgagtactattaaacacaatgtgtcttcttcaattatttgatagagtaactggtgggataattacaatgaaaaatctgctacttttacaaaaactttaaaataaattcaaatttatctaggaattaatagtagacatttggttcagaaaaaagaagatcagggagtgaaaaatgtagctgtcaggtaagtggggtagcatgcacagaattttatcataagttgtaatattcataacattattagcagatgcatttacaaaacaaagaaattcaaaagtagactttagtatgtataacatttaatgtgtaacaatttcagtattgtacattcttagaggaaacacctaattatggaataaatagcattagccaactaatcagaaataaatgactaacaattcaactttatatcctgtattagtcagggttctctaaagcaagagaaataatagtatatatgtgtatataaaagtgagtttattaggagaattgactcacacggtcacaggatgaagttccacactaggccatttgcaagctgaggagccaggaagccagtccaagtcccaaaaccccaaaagtagggaagctgaccatatagccttcagtctgtggccaaaagcctgagagcccctgacaaatcactggtgtgagtccaagagttcaaaagctaaggaacctggaagtcggatgtttgagggcagaaagtatccagcatgggagaaagatgaaggctgaaagactcagcaagt

SEQ ID NO: 734129 - DNA, 718 bp, Homo sapiens
cttgagactgagtcttgctctgtcacccaggctggagtgcagtggcgtgatctcggctcactgcaagctccgcctgggcaacagagcaagactccgtctcaaaaataagaaataaaaataaaataaaaattactcttccaagttgttgataaacatccttttctttattcttcttcaagatttattttcttggccttcccaagctgctttcgcagactttctgcctggctctttcaaatccacagcagcccctctctttatatgcccaccttcctttcttaaacacgcacacattctccaagcagtgcctgacagccttctttgcatcaaggagcacttacaaatgatccagagaccgaggagaatactgtctaggcacacctgctggagactcctccccgaaactctccaacatccctcttgccagatacaatcaacatgtgaagataatgaagaccaagaaaaaagcctcctagggcataggatacagctgatcctcctccctacattcagcgattggcctgctctgctctcgctcctccgacagcttcacctgctcctcttcatgttcctgtgcctgggtccagggctcatcctgttgtggtcgtggtgggcggcttcagccctttaggagcttcccttgggctctctcctcagggacagcttaaggagcaccagtgtgggagttcaccctttcagttcaaatgcagatcagtcc

SEQ ID NO: 734130 - DNA, 1061 bp, Homo sapiens
  misc_feature (34)..(34): n is a, c, g, or t
  misc_feature (54)..(54): n is a, c, g, or t
  misc_feature (56)..(56): n is a, c, g, or t
  misc_feature (62)..(62): n is a, c, g, or t
  misc_feature (164)..(164): n is a, c, g, or t
ggctgcaggatttttcacgagaaaaaacaaagcncttcaggtcaggagaatgtntnaatgtncattgccatcgaggttctgctatttttgagaagctgaagcaactccaaggacacagttcacagaaatttggttctcagccccaaaatactgattgaattggngacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggaaaagtgatagatgacaacgaccacctttcccaagagatctggtttttcggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtggggggagatggacccgtttaaacctccgagatgagctgctcagactttacagcatgacgactacaatttcttttctaaacttctcttttctgggattataaatcccaatcggttcctagctgaaaaagttaaaaaggccggttttcccttctttcaaccagtttggttgagtaaatttgtttttttaaaataaaaattgttggcgttt

SEQ ID NO: 734131 - DNA, 1007 bp, Homo sapiens
  misc_feature (34)..(34): n is a, c, g, or t
  misc_feature (54)..(54): n is a, c, g, or t
  misc_feature (56)..(56): n is a, c, g, or t
  misc_feature (62)..(62): n is a, c, g, or t
  misc_feature (164)..(164): n is a, c, g, or t
ggctgcaggatttttcacgagaaaaaacaaagcncttcaggtcaggagaatgtntnaatgtncattgccatcgaggttctgctatttttgagaagctgaagcaactccaaggacacagttcacagaaatttggttctcagccccaaaatactgattgaattggngacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtggggggagatggacccgtttaaacctccgagatgagctgctcagactttacagcatgacgactacaatttcttttctaaacttctcttttctgggattataaatcccaatcggttcctagctgaaaaagttaaaaaggccggttttcccttctttcaaccagtttggttgagtaaatttgtttttttaaaataaaaattgttggcgttt

SEQ ID NO: 734132 - DNA, 650 bp, Homo sapiens
cggaaagccatgtgaggacacagtgagaaggtgatgtctacaaaccaggaagaaaggcctcaagagaaaccaaccctcccctggcgccttgatcttgcatttccagcctccagaactatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtggggggagatggacccgtttaaacctccgagatgagctgctcagactttacagcatgacgactacaatttcttttctaaacttctcttttctgggattataaatcccaatcggttcctagctgaaaaagttaaaaaggccggttttcccttctttcaaccagtttggttgagtaaatttgtttttttaaaataaaaattgttggcgttt

SEQ ID NO: 734133 - DNA, 2826 bp, Homo sapiens; identical to SEQ ID NO: 48717

SEQ ID NO: 734134 - DNA, 513 bp, Homo sapiens
  misc_feature (418)..(418): n is a, c, g, or t
  misc_feature (463)..(463): n is a, c, g, or t
tctgttgcccaggctggagtacagtggcatgatctcggctcactacaacctctgtctcctgggttcaagcaattctcctgtctcagcctcccaagtagctgggactacaagacaggcatgcaccaccatgcccggctaatttttgtatttttagtagagacgggatttcattatattggccaggctagtctcgaactcctgaccttgtgatcctcctgcctcggcctcccaaagtgttgggattacaggcatgagccaccgtgcccagcaggctcattttttaactttgcaatattttaacttgacagaccatcgtttgatgtccattttaccaccgtctacattagttgaggtcctcaatatatcttctttatgaacctaagtctctttgatgtcaaagtattaaatatcattggtnatgcctgccagctacttggaaggctgaggtgggaggatcacttancccaggatttgaagccagactgggcaatgtagcaagtccccatgtcttaa

SEQ ID NO: 734135 - DNA, 549 bp, Homo sapiens
tgtagttacacaggtctgaattcaaaatccagctctgccacttggctgctgtgtgaacttaagcaagtcgggcaatgtttctgatgtttttttttcctcctccacaaagaataattaatatataacaatagggtctcagctagttgttttaaaaatggttagagagatgtgtggaatgaagtaagtgtgcagtaagtgttaactacaaatattattatcttagacatacagatttccatgattcatgaatggtgaagcatcttagaagacatccattccaggccaggcatgggggtgcgcacctatagtcccagttgctcagtagaatgaggcaggagaattgcttgagcctaggagtttgaggctagtatgggcaatatggtgagaccctatctcaagaaaaaagcaaaactttttttaaagtttaaaaagagagacatctgttccactactctcatcttagaggccagaaaactgaggctcagataatttcagagactttcacagatcccccaaccatttggtggcaaagccaggaatagaactctg

SEQ ID NO: 734136 - DNA, 705 bp, Homo sapiens
atcagaaggaaagaagaaatgatgaacccagatttccattacaggatcctgggaagcagagtgtctggatggaacctgagctgggtctctgactcacttctgactttagggtgaagatggagggaatctgataaagacatcttataaattcaacagacacaaaagaatttgatctcccataagcaactgtgaaattacaataacagatcctgggaagttctacaattctaattcaggtttacaagttttcttctcatctattcagtagatattttgtcgagtacctgtgctaggttcagctgtgcccccaaaacatgtacattcctaacttttattacctgtgaatgtgatctcatttgcaaatagggtctttgtacatgtaactgagttaagatgaggtcatactggattagggcagaccctaatccaatgaccgatgtccttatatgaagagggaaattagacacagagacacacagaggaaagacagctatgtgaagatggtatcagagaatagagtgatactgccacaagtcaaaggatgtcaagaattgctggcaaccaccaaatgctagaagagtccagaaaggattttctcttagagcctttgaaggaagtatggccctgttcttcttgattttggacttgtatcctccagaactgtgagataataaactcctgttgttttaggccactcagtttatg

SEQ ID NO: 734137 - DNA, 1605 bp, Homo sapiens
ttaattcatatttttgtgggtaaaatgttattacccttaatacaaagcaaagtttcagctggacttcgtttttacttaatcttcaatggaacattattgaagttacagtacaaaaattctctgaatgaacataataataagttgtaaaatatatatatctttataaagatatattattggatctttcacaaaaagtcatacaagtggggaaaaaagaaaaatatcagagtattgggatttgtccttgaatcttctcttttagctttctttcagttaaacctgtgtccacatgtttgtttctggattgaagccagaatcaacattgtccctatttctaatcaaataatggagaaataattacaaattcccaatgcagttacaggatcctgggaagcagagtgtctggatggaacctgagctgggtctctgactcacttctgactttagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaat

SEQ ID NO: 734138 - DNA, 619 bp, Homo sapiens
  misc_feature (31)..(31): n is a, c, g, or t
  misc_feature (39)..(39): n is a, c, g, or t
  misc_feature (41)..(41): n is a, c, g, or t
  misc_feature (43)..(43): n is a, c, g, or t
  misc_feature (47)..(48): n is a, c, g, or t
  misc_feature (51)..(51): n is a, c, g, or t
  misc_feature (53)..(53): n is a, c, g, or t
  misc_feature (56)..(56): n is a, c, g, or t
  misc_feature (65)..(65): n is a, c, g, or t
ggaattcgcgccgggggagagagtgagcgtnatgcacantntnagannttnanagntggagatgnaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaat

SEQ ID NO: 734139 - DNA, 1356 bp, Homo sapiens
ttacaggatcctgggaagcagagtgtctggatggaacctgagctgggtctctgactcacttctgactttagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaat

SEQ ID NO: 734140 - DNA, 894 bp, Homo sapiens
  misc_feature (842)..(842): n is a, c, g, or t
  misc_feature (844)..(844): n is a, c, g, or t
  misc_feature (851)..(851): n is a, c, g, or t
  misc_feature (856)..(856): n is a, c, g, or t
  misc_feature (869)..(869): n is a, c, g, or t
ttacaggatcctgggaagcagagtgtctggatggaacctgagctgggtctctgactcacttctgactttagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaaggaattctacgagtgaatatggggatatctgggacancngggaatncctgnggggaattcatcngaggggaaggtggctgtccccagag

SEQ ID NO: 734141 - DNA, 1041 bp, Homo sapiens
gcaagttatttaatgtctctgcatttttgacatgcttgtaataatgctaatttatttcacagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtttgatgtcttatgagcatagttgtaatggagttgatgatatctcactgatagacattaattatcaatataatatgtatggtaatgttagtctttatttataatattagtattattaagtaatcattctcattagaattcttcagcaatgaagtcgttttgaggatttgttcattgtgtaca

SEQ ID NO: 734142 - DNA, 1220 bp, Homo sapiens
gcaagttatttaatgtctctgcatttttgacatgcttgtaataatgctaatttatttcacagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaat

SEQ ID NO: 734143 - DNA, 1426 bp, Homo sapiens
ttaattcatatttttgtgggtaaaatgttattacccttaatacaaagcaaagtttcagctggacttcgtttttacttaatcttcaatggaacattattgaagttacagtacaaaaattctctgaatgaacataataataagttgtaaaatatatatatctttataaagatatattattggatctttcacaaaaagtcatacaagtggggaaaaaagaaaaatatcagagtattgggatttgtccttgaatcttctcttttagctttctttcagttaaacctgtgtccacatgtttgtttctggattgaagccagaatcaacattgtccctatttctaatcaaataatggagaaataattacaaattcccaatgcagttacaggatcctgggaagcagagtgtctggatggaacctgagctgggtctctgactcacttctgactttagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtttgatgtcttatgagcatagttgtaatggagttgatgatatctcactgatagacattaattatcaatataatatgtatggtaatgttagtctttatttataatattagtattattaagtaatcattctcattagaattcttcagcaatgaagtcgttttgaggatttgttcattgtgtaca

SEQ ID NO: 734144 - DNA, 1177 bp, Homo sapiens
ttacaggatcctgggaagcagagtgtctggatggaacctgagctgggtctctgactcacttctgactttagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtttgatgtcttatgagcatagttgtaatggagttgatgatatctcactgatagacattaattatcaatataatatgtatggtaatgttagtctttatttataatattagtattattaagtaatcattctcattagaattcttcagcaatgaagtcgttttgaggatttgttcattgtgtaca

SEQ ID NO: 734145 - DNA, 1277 bp, Homo sapiens
ttcaaaaacctcatttattatggagatttacatgccaacagtacaattaacttctataaaccacattactgtttagaaaacacataagcaatgtcatatagagattgagagcacagtccttgaactgaatttgaatcccacctccgcttacccactgggcatcaagactgagccctttcctaccgcatggaattgttatgaggatcaaaggagacaactataaagctcctagcatagcgattccaattattttatattatttgatcttttgagtccaggagttttcgcataagccataatttccaattcttcaaatagtaggcattattagaacttttcaagccactttctctttggaataatattctgaaatgggaagcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtttgatgtcttatgagcatagttgtaatggagttgatgatatctcactgatagacattaattatcaatataatatgtatggtaatgttagtctttatttataatattagtattattaagtaatcattctcattagaattcttcagcaatgaagtcgttttgaggatttgttcattgtgtaca

SEQ ID NO: 734146 - DNA, 1456 bp, Homo sapiens
ttcaaaaacctcatttattatggagatttacatgccaacagtacaattaacttctataaaccacattactgtttagaaaacacataagcaatgtcatatagagattgagagcacagtccttgaactgaatttgaatcccacctccgcttacccactgggcatcaagactgagccctttcctaccgcatggaattgttatgaggatcaaaggagacaactataaagctcctagcatagcgattccaattattttatattatttgatcttttgagtccaggagttttcgcataagccataatttccaattcttcaaatagtaggcattattagaacttttcaagccactttctctttggaataatattctgaaatgggaagcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaat

SEQ ID NO: 734147 - DNA, 1041 bp, Homo sapiens
acaagatgcaattttaaaacgctgatttctataccatgtgttatctgtctccagtgatactgagtagtctcattcagaggctccctaaggcggggggagaaaaagacacataatgaatgttacattaccttgttttaaaaacagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaat

SEQ ID NO: 734148 - DNA, 1201 bp, Homo sapiens
gcaagttatttaatgtctctgcatttttgacatgcttgtaataatgctaatttatttcacaggtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtttgatgtcttatgagcatagttgtaatggagttgatgatatctcactgatagacattaattatcaatataatatgtatggtaatgttagtctttatttataatattagtattattaagtaatcattctcattagaattcttcagcaatgaagtcgttttgaggatttgttcattgtgtaca

SEQ ID NO: 734149 - DNA, 1380 bp, Homo sapiens
gcaagttatttaatgtctctgcatttttgacatgcttgtaataatgctaatttatttcacaggtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaat

SEQ ID NO: 734150 - DNA, 1264 bp, Homo sapiens
gtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaat

SEQ ID NO: 734151 - DNA, 1266 bp, Homo sapiens
gtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtttgatgtcttatgagcatagttgtaatggagttgatgatatctcactgatagacattaattatcaatataatatgtatggtaatgttagtctttatttataatattagtattattaagtaatcattctcattagaattcttcagcaatgaagtcgttttgaggatttgttcattgtgtaca

SEQ ID NO: 734152 - DNA, 1445 bp, Homo sapiens
gtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaat

SEQ ID NO: 734153 - DNA, 1288 bp, Homo sapiens
gtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagttatttttgttgttgctggaagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtttgatgtcttatgagcatagttgtaatggagttgatgatatctcactgatagacattaattatcaatataatatgtatggtaatgttagtctttatttataatattagtattattaagtaatcattctcattagaattcttcagcaatgaagtcgttttgaggatttgttcattgtgtaca

SEQ ID NO: 734154 - DNA, 1467 bp, Homo sapiens
gtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagttatttttgttgttgctggaagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaat

SEQ ID NO: 734155 - DNA, 1413 bp, Homo sapiens
gtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagttatttttgttgttgctggaagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaat

SEQ ID NO: 734156 - DNA, 572 bp, Homo sapiens
acgggtagctccaggaacaaacccttagctaacagtttaccctgccctgggggctgcagctgcgaccacatcccagggtcgggtttaaagatgaactgcaacaacaggaacgtgagcagcttggctgatttgaagcccaagctctctaacgtgcaggagcttttcctacgagataacaagatccacagcatccgaaaatcgcactttgtggattacaagaacctcattctgttggatctgggcaacaataacatcgctactgtagagaacaacactttcaagaaccttttggacctcaggtggctatacatggatagcaattacctggacacgctgtcccgggagaaattcgcggggctgcaaaacctagagtacctgaacgtggagtacaacgctatccagctcatcctcccgggcactttcaatgccatgcccaaactgaggatcctcattctcaacaacaacctgctgaggtccctgcctgtggacgtgttcgctggggtctcgctctctaaactcagcctgcacaacaattacttcatgtacctcccggtggcaggggtgctggacca

SEQ ID NO: 734157 - DNA, 1062 bp, Homo sapiens
tgccaatgtagtgttccagacagttttatcatccacattgctgacctggaagatgcatcattgtctatgatatctgcaatggaaatgatcactaggcaatttcagccttgcaaatctaactgtggcgtgtggaaagaagaggaaccagaaaagaatgtttgtgaagttctggcttgaatctcgtgccgggagtgtgaagaaggtccttgcttccccttcaccttctgccatgattctaagtttcctgacgcctcccagccgtgcttcctgttaagcctgtgaaactcctttggaatgagtacacatccaggagtgaagaagacaagctcaactgccattctctgagcagttcaaggcatactgagttgcgggagttgtgtggtggtccactctgactgcaagcacccctttcttgaaccgaacagagtcaagtggaatcaaaggacattacctgttgattcttgggcaaggcccagaatttggtggacatacttaaagaagaaaggaatcttcagctaaagtgtctacgatcaattcagatttggagggcatggatcttctgacagtaggggccattctaggattttttggttgaagagatgaacttcaacttggttccagatgggtggtccagctattctgctgacaacatttttcagggcaaggcttttgctactggaatgatttaaggaagatccctcagtgtttcagagtaaagatatttctaaagaagtacctgtgtcattgcccatcttgaagattgacttttatggattgctcaaatactgatatcagctcaatgtcaatatatactcctacatataaaatccatcttctaatcataatcactaggtaagatgctagtgcaagttgaagttcttaaaggagatgacctgaacagccttcttagtgtaccagggagaccagattgagtttaaactatgtttaccctgcactcagacacgcctaggtgtgtctgggagattagtagatggtgttcaacaaggatctatttaaacaagggagacattaatttggattcctttggttgtaaatttccaa

SEQ ID NO: 734158 - DNA, 606 bp, Homo sapiens; identical to SEQ ID NO: 370459

SEQ ID NO: 734159 - DNA, 526 bp, Homo sapiens; identical to SEQ ID NO: 728860

SEQ ID NO: 734160 - DNA, 743 bp, Homo sapiens
ctgctccttcttttggattattcccttaggaatatctccaaagagggattacaaggtcaaagagcatgaagtattttatagctcttgttttatattgccagattgctttctagaaagatccaatctttgggttggaaggaccttaaaggtcatctagtttagcctccccaccccctctgaatgcttgaatcccctcgacaatttatgatgccaccagcaatgtataagcatttctgtttaccaatagctctgccagtattgggttttgccatttttatttatttttgctagtttaataggtatgtatagttgttcttgaagagttgttttatttcattaattgctagcaaggctgagcacttttccatgtgatgatttactagttgtatttccttgtgtgtaaaatgttcattcatttcttatgaccacttgttaagaggaactgatctcatatatttgtatcagaactgtatttttatgttatattgtatagtttgctctcctgcccctctccttaaaactgaatggtgccaataatttgatactaatgactacaaaaaaaggtaatgcctcatttactagtattgttgtaaaatgaggaatgtatgtgaatattcagataaccgaggattaaccctttaagtgctgaatctttaaaattttaatatatttttttttgagggaaatctttctaaaatgtattacgcacttccctgccttagtaaacagagtatactggagag

SEQ ID NO: 734161 - DNA, 827 bp, Homo sapiens; identical to SEQ ID NO: 728861

SEQ ID NO: 734162 - DNA, 681 bp, Homo sapiens
aaggagctgagcagatattctaagagtttcacggggataaggaataacatggaagcttaagacccaataagaagcagacaaaatatcccagcatttcagttggaaccctggatgggattcatttcaggagtaatagggaaccagaaacaaaggacggtcatgaagattcaagcccactgagattagactagctgatctgcctctaccctaactttcaaccagaaagaaaataaacccgctagcagtaacaccccatcctagagtctggaattatctctgaaaattttcacatacccatatccctgatttcaataaaaaattatcagtcatattaagaagcaaaataaatgatcaaaagccaagaggaaaaaaatcaagtaaaagaaacgagccaacaggagacaggacacgggtgcacgcctgtaatcccagcaccacaaggtgggtggatcacttgaggtcaagagtttgagatctgcccggccaaaatggtgaaaccccatctctactaaaaatacaaaaattagccgggcatagtggtgggtgcctgtaatcccagctacttgggaagttgaggcatgagaattgcttcaacccgggaggcggaggttccagtgagctgaggttggcctctgcactccagcttggctgacagagcaagactctgtcaaaaaaagaaaa

SEQ ID NO: 734163 - DNA, 1058 bp, Homo sapiens
agctactcaggagactgaggcagaagaatcacttgaaccccgggaggtggaggttgtagtgagccaagatcgtgccactgcactccagcctgggcgacaaagtgaaactccgttctcaaaaaaaaacaacaaaacaaaaagtaacaagaaaaaagaaactatattccaaaaatccaaatttcattggcagtttgttctgggagcttcagacacatagaaggtgtcagttaaccagttcttacctaagaggtactgctaagagcctagtccctaagcaaagggagcttcagagaaacacagaaggtgccagttaaccagttcttacctaagaggtactgctaagagcctagtccctaagcaaaggacattcctcgtagctctgtcctgtctcctcatctccaaaatactttaccttctactttgaaatgcccactattatattcaaaagccctagttacttccagggaaaattatctattgagcaatgaatttcggtagcttcaattggattccaactcttgagcaagttttcatctcccttgcctgaatggccctggggaggactatttaaattgggggcgagtggatgaggatgctaaacctagaggtctcccaattaccaaaggcacctgggcaccagggactaaagtttgtctcaggaatttactgagatatgaggctgagataaaatcattttttggtacataaggtatcttgaacaaagcagatcagtttaacacaaaatcaacaatcgtaatttccctttttaaatttccaaatctatgtagcaatatcctttcctttaattcattcatcatctctattcactttttgtattctgtaaatcatttgaacttttataagaattatattttccccttgaggtcacaaaaaagaaagtattagaaattttataaccaatttttaaaaaattatattttaaggttaaatacaaccttctaaaggtttgtcatctgttgatcctaaattataattataaatttatatattcctgttgaatataatgcatgtgtgttacatattacgagggatccttg

SEQ ID NO: 734164 - DNA, 1050 bp, Homo sapiens; identical to SEQ ID NO: 20972

SEQ ID NO: 734165 - DNA, 1407 bp, Homo sapiens
  misc_feature (643)..(643): n is a, c, g, or t
cagtgaactgcctgctagatgccaggcaagtttaaaggaaaggtcaatgagaaataaagtgctcaagggcagattcaaggaaaacatggggagcattgcagagcaaccaggtcttaaaagagaagttaaggagaacagcaagaagcaagcacacaggagcaggcagaggcacactggttgagaaagtaggatgcccagcagcctggtctgattaaatcagaaattccctctgtaggaggacaagcaaagcatattatcataggctgggcagaattccaaaggtcatttcatccaacactcctcagacgctgaaactcaaggtttcgaaggcaaaagtggaagtgtagacaattgctacagaattgaagcccaacattctgtcctttgcctttcataatttgagacaaaattaaaaccatctgaaatatctcccttggctgcttttttcaaactttaatttccctgcaagtatatgataattgagtttctttagagcacaaggctggatatattggaccttaatgtgcacaagttcatcctagaaattgtctttagagtaccaagtctttcctccccaagagttccaaaactaattcaatatttagaatgctcccctggacctcccagttccagtggctgaatntcagggctcaggcattagaggattctttttgttctttggccctcttggggactaaatgccatgtatgtcaccatgtcagtgactacagccttggtttcatcccctgatgacccacaaccatcatctcccttatgctgaacatctctctgaatcttggaattttcagatgactctaactttgccaaattagaatcatgcctgattctttttttgtttgattgtttgctttatgtttgtttactttgctcagtgccaagcacaggatttagcataagaaaagttccactagaggttgtttattcaagtaagtaattattatagccatccgtatatgaatgctttacaaaattttggctgatggtcctcgcaggtctgttttattagtcaatttataaactcaagtttatgtcttcaacttgaccatctcctttgacttccagattcgcctcttcccacaaaactgactctccacttggacatctaacaggcatcttaaatttaatgcatccactttggggggctgaggtgggcagatcacgagatcaggagatcaagaccatcctggctggcacggtgaaaccccgtctctgctgaaaatacaaaaaattggccaggcgtggtggcaggcgcctgtggtcccggctactcgggaggctgaggcaggaaaatggcatgaacccaggaggcgtagcttgcagtgagctgagatcgtgccactgcactccagcctgggcgacagagcaagactccttctcaaaaagaaa

SEQ ID NO: 734166 - DNA, 1311 bp, Homo sapiens; identical to SEQ ID NO: 728863

SEQ ID NO: 734167 - DNA, 493 bp, Homo sapiens
agaaatggagcaaagcaactatacctcatgggtcagaaaatgattttcatgagttaataaaaaattgtatcttctaaaatttttcaaataacacaaaactagactttcttgcttagggtaaaaggatggattctgataagaaccatctttttgtttcctaatatttaaacatcctcttttgtccctcatgggaattaacaaagaattcttgagtctgtctggtagataaaaacgtcaacagtgaaaacacagtttcaagaaaagtatttctttcttgatggggtgactttcacccatggaagagcatgctctatgaagttgtctatttcacaaatatgataattttatattaaagataattttaaatataaaatatattttaaaatatttaaatatgaaatgctcttagcatattactctacattaataaaggttccaaaacatattctttccaacatttatatttttctttctcagatgtttctgggtactc

SEQ ID NO: 734168 - DNA, 1003 bp, Homo sapiens
tttgataacaatctaaataagctgcagttgaagaagctgaaaaatgaaggcctgaatgtgcccctggtgtgtaagacaaatgtatctaggctctagagcaggctcccattctccaccgatacacatcatgtgccagttttgcccagatgattctaaattactctgtagtacttgcttgttctgagggtgggacctaggttctttccagtcgtggatttgtatgactgaatgtgtttcaaatgggtggtggggtgctagagctgtttagagagggcctgttggctgctcctggcttacccacttagactgcctccgtttcatacccaaagcggaggccgtcagcaccaggattgagacttcctgtgggcaccaaacaggaagagaccagcaacttcgcattacccgccattttcatctttgccagtcccttcagtcttggctaggctaccgagagccaccatacaaggttcatctctagagaatttttgcttcttagctatactttaaatattttggtcatcaaagacaagtaatgtgtctcagatgagaggcttgaatttgatggccagatataacctctgaggcttttaacattttcattttaagagtaagcaagacacatgaaattaaacctacaaggaggtatttgtggctggtgccaaagcattctgacactttggggtgtcattttaatcaaagaaatcaccccgccacctcaccgggattctccataacttccctctgcagaactaattatgttgattttgttcaagttcaagatgttagctaaaagaactatgggtggtgttttttttcccacttcccacaaacctcaacatgtgccagtcaccctaaaatgctttcacatgggttaaaaacaaggcacaattttggaatcctacagcagggatgaaaggcccctagccgtgaaaacagtgctttggggagcagttgtcagtctaagtgatgctattccaagagaaggatatgctgagggaaaatg

SEQ ID NO: 734169 - DNA, 2492 bp, Homo sapiens
  misc_feature (427)..(427): n is a, c, g, or t
gttttccctgctgaaaacccaacaccagacggaaatgccaagtgcccaccccagaccccaaaccctaaggttggaccccaactcggaaccaggagtggagcgtggaaggtggggacagtgctcagggcccagtccagttggcactgacagcttccagtgtccccgctccatttccactagttcccctgggacaagcggcccctcactgggtgtcattcctacccaatgagttgatggaaaagtgggattcgtgccccacccaccatcatgcaagaaaaacaagcaaaacgaaacccagactgtagtttgccatcagggcaaaccactttctcaacatttttttgtggggggatgaacagtaaaccttgtggggccactgtggaaacttaaccgtgggtctcaaaccttgatgagcctcatctgtaanatgggttcaagaaagtcatctccccagagacggcggaaacggtccacctagggaacagagtggggcatcttttcgcagccgagcccagaacccatcacctaaagagttctggatgattcgttttgattttttttttttttaaatcaccatcgctgtcgtcatcagagtctcgcctagggcctggcacagagtagacgctcagttagaagctgtctggccttttcaccttctcccgggtcagcacacacagatttgggagtatttacctgcacagaacgcaccttcaggaactgccaaccagaagcaaaatccaaagctgctctctgcgatcccttcacttttaactctcagtctgcactttttttttttaactgagcatctattatgtgctaggcactgttccagtgctcggggacgcagctgtgaatgaacagaaacgggggatggaggacaggggagaaacccccttcacgggccttagatggcagggggtagggaaggagagacagaaaataaacagaaatatctgtccccagctgccagaggaggaggaaatgggcttggtgatggtgacattaagttctttgaaagctgggtttgttggcctctgaactctggcctttgtgggatctgttcttttggaaaagatgggagcccctgtgttcctagatcccagcctggccgggtggagtagggtggggaggtggtgtccacctgtgtggccccgttctcactccctaacgcccgtcccttctcccccaggtgaggggccttcccatcccaggagggttttctgcttccaaccgatccaggacttacccataaattccaaccgttctttggacaccagccctttcctcccctcttctccccttgccctgcccctctactggaggccacctggagtggcgaggggcctttggggtctgtcctggggcaggggcgggggtgggggaggctcctgaatcgtgggcagaagtgttcacacgccccccctgctttgggaaacgctctcgcttcttccccacaaaacttggtgacttccccaaactaaatcacaccttttcctatatatatatatatgcatatatatatagatctatagacagtatatatatattttgagtacggatcatgggaccaaacttttccgacttccttccatccgagtagagtgaccctgggccggtcactcagcgggggacacaggaagggctgaggttggcgggaccccgcgcaacacataccaggtgccccacccccacccccaccacctcctggctggcacatcccaccaggaacccgccaacacaacatacctccaggacttttggcaccccccaccaccaattctccagggccgttgggctctgccagcttcagtgtccctggtcccagctgcagcctccagaccccacctcgccccttcgtcccagagccctgccctccgggatggatataggtacaacagagacgctctggcctgcctcagcccttctctgctcccctgcccgagtcatagccttactcatgtgaccaatagcccttagctttccgtcggagggggggggcggacagggttggggggagcccccctgcccctcaccaccccctcccaaggccaggcagccattgtcccctgccttcgaatcaccagcctcgaatttaaggtcttgtaaccaggattgccaagcgtagcggaagaccctacccggaccggccaagcacccctttaactggagacgaacttgataatgaccttcatacctctacagagatttttttttttttccggtctttctgagcaggtacaaagaagaaaagagaagaaaaagatggggggaaaaaatcaaaccacaatggatttttgtttcctagttgggagtggggtggggtggggtgtctttgtgagggtgcctctgtacagctgcccaatccgcgacacccacgtcaaagcacagcatcaagttcgtttggacatccggcaaggcctcttaccaaatgaggcgccagataacttaataagctcaaaagaaaaaaacatttaaaaagaaagaaaaaaaaa

SEQ ID NO: 734170 - DNA, 569 bp, Homo sapiens
actggatttggggtatatgggaactctttattttcataatagaatttcatactactattggaaagacagtttattcctgtaagagataattcatgcaattatcataatagtatttcataacactattatgaaaatagtagagttctataaatcaaaaactattttaaaataaaaaaaaatttttaatgtttatgtccctaacaggtggagagaaggtgaaaaagaccaagaaaccctcaaggtttcaggttctagtaatgacgagaactctgctcaggaacggaaggctggctctgtaccgcacagctctaccccatcaacaggaggccaaagactcaccatgcctctggtctgttccactgaccttccttttctacttgctgcttatccacaaaagcagaacatttcattcactagtcaagcccttgtctccgactcttgagttatcagatgggctgttgttgagccaacttttattggaagatgctacagatgaaaagacaagaccttcactaagggtcccttccaaaggtaaaagtgaaaagattcaaaataactcaaagggttta

SEQ ID NO: 734171 - DNA, 904 bp, Homo sapiens
tgttccttagcacaggtggtgtggatttaatttcttctcctggggtgacctacttgtatctagaggggagaaatattgtaatgaaatgctcgttacttacaaaccacaccaaattccaggtgtactgtaccaaatgcatggaaatgagtagaatgtgctctcccagacctgctagccaaggtgaaaatgcttccctgaaattactcatttgcaaatgcctttgaagtcattagataatacacttggcctcaaaggcaccaggcagccaaattttacgttggagctgtgtgtacccaaccgtggaatttgcctcccaaactatagcaaaactgataatgcatatcggttttaaaaagcgaattttcaccttgaatctttctcctataagaccactgggaacagaacgctaatgtatcctggcctccctccaattctgccattatagattcaccttcttaacccataatacatataattccttcttcctagtgcctgccttattgaggccatgcacacatgtgaccactcatccagcatatttgctgggagaactgaggtaccatgacttggtgctgcagttgattagcctagaaatcttaagaccattccaagagcacgattttatggccctctgattcatgctatggatatgtaacatgatttctgatctgtgggagctgccagataggcctgtcccaaataaagatcgtcacaaatctttactgaatgatattattgggaagtgcacaattatggcaccctgtaaccacctccagaactttccatggtaggcatgggcccaccccattcccttaccctgaattggttcaatactgtatctggacataacaggttacttccaaccataatctgcatcgtggatagacataaggaaaaacagctt

SEQ ID NO: 734172 - DNA, 530 bp, Homo sapiens
  misc_feature (365)..(365): n is a, c, g, or t
cgcccattgggacataacggcagtgcggcgcgacagcaagagaatgggctggaaccggatctgtttccagacgcagaatgagtggctctgtgtgaccataggcagatgctgactctggaagactccgtgccactcctttctagtgccaaacaccatccaaccacaggactgacgtggaagccccaaacaactgagaatgagtggcatgagccccctaaaagcaggcgagagaacgagcaatcaagttctccactgtgtacagacttttcctccccccaatccaaggtcaaagtgatgtgtcttttagaggctttggggacactttttagtaagtatgagcagacaaatgcaatgaatatgctatngaaaaaacccttcttgaactgaggagagggctttatcactatatccagctaaggatttgtatttgaatcatctgtaaagtcgcactcttacaacaagcttctgggttttaaatacctccgtacagcaagtaaacgttccccgctttctgttctcagtgtcctcgg

SEQ ID NO: 734173 - DNA, 1784 bp, Homo sapiens
  misc_feature (857)..(858): n is a, c, g, or t
  misc_feature (876)..(876): n is a, c, g, or t
  misc_feature (1020)..(1020): n is a, c, g, or t
  misc_feature (1099)..(1099): n is a, c, g, or t
aaaggaatatggaaccagtatgaattaaaatttgtgttttcttcaacattccataacatcactaagaaataaaaaattataaaagctacatggttaaaaagtaccatgctggccaagcgtggtggctcatgactgtggtcccagcactttgggaggctgaggtgggaggaaggctggagcccgggagtttgaggttgcagtgagctgtgatcacaattgcactacagcctggacgacagagtgagaccctgtctcaacaaaaagtacaattgtttgaaagaatgtatacatgttttttactttttagtgaaatatattgtttttaaacattccttggtagagagaatttttttgttggataaaagggaggtatttttgttaaggatatctgggcaccctaaaaatttcatactttatgtccactcattaccgtatgggagaaaagttgctaccattaaagtatgtggtttgtaggagctcctaaaataaaactcttcagttttccaccctgaagtcagcttttggtcataccagattatgtacatatgtagtgggttcatgccatacttttagaaggccagcagagggagcactactcaatgtacagtgtttactgtactgctgagaagactagtattttctatggctcagtacaaaatgaaaacaaaattaaatttcacaactcctcaaaacaaaaccaaaacaaaatttttcattttattcgtgggttcaggtttcagacatgctatttattagtgactgagcagattattttatttctgtgtacttttttgcctatatatgaagactactcaattaccctattttagagggttggtttgtttgtttgttttgcnncagggtctcactttgtcntccaggctggagtgcagtggcatgattgcagcttgctgcagcctcaacgtcccgggttcgacggattctcccacctcagcctcccgagtagttcggactacaggtgtgcgccaccacacccagctaatttttgtatgttttgtngaaatgtggtttcactatgttgcccaggctggtcttgaacccctgggctcaagtagtcctcctgctttgtcctcccaangggctggaattacagatgtgagccaccataccccgttagagttgtgtttttagatttttaagttattatggatacatcctagttgcacatatttttgaggtagatgtgatattttgatacaagcatataatatgtaatgatcaaatcagggtaattggagtatccattgcctaaagcatttatcatttctttgtgttgggaacattccaattccactgtcataattgttttgaaatatatagtaaatgattgttaactataattgccctatagagttacgttgtcagtctacttagtggcctagcaaagaggaagaaacatagtaatttacgcaaattccaggtggaaaatagagaaagtttagagaactaaattagtgtaaaacttaaaagtatttctgactataaattctaccattaaaaacaaaaaagcacccgtgaacccacaaggataaaataatgtgtttgtccctgcccttccttgcatatcctgggtgaggctggttgatggtacattgttgtagaataattgcggaattttatttacctggaagtttgctgagaaaacaatgtctgaggtggtgtaagtttttggaaagcaaacatttgacagagttctcataattgattttcattttccaccctttattctgttaaagttctgaaatattgcataaggccatctg

SEQ ID NO: 734174 - DNA, 1700 bp, Homo sapiens
ccccgttccccctccgcctctccctcctgacctacccgagtgctttcctgagtggctccacgtggcctcctgtttctagggatgggcacttctccttgctgccaccatgtgaagaaggacatgtttgcatcccttcctgccatgattcctcaactggctcactgccttctttatcccagcctccattgcagtgaggttgggggccatatgactagtgctgcccaatggactgtgaacagaaatgacagcatcactcgcatggagactcctccatctctgtcttccctgttgtgacagtctcagagcctacgttctttcaatggctgggctacaagatggtgacaggctgcccaacctgacacagcaagaaggcggccatctgcaaaccagaaagagagccctcaccaggaaccggatctgctggcaccttgatcttggacttcctatcctttagagctgtgagaaatgtcgcccccaggtcaatgggatatttgttacagcaccaggtactgcctgagaactctacctttagggagcctgcgtgctgggtcactggggagacaatgaaggtgcttgacacccagtttgaatattgtgttcactgcaaagctgactgctgttgaaggatagccagtgagaggtcatggcaagccatcagaagaagcagaagtcatgagcatgctgaagctatgaggccaagacaaaatgtcacattgccacaagaagagggacaaacaggcaacaggcagagcccatgggaatcagtaatctcctgctgacactgagcccttgggactaactcagatccagtactactctcttgggacatgttctgactccagctcctgtccttggggtccactgagatccctgtagccttgtaataagcccacattatcatatttcccctgccggctccaccctagagcatttccaacaatttccagtgcttttccccttctcataccactgggcctttgcacgtgctcgtgcctccccaacttgccctgccttctccttcacccagacaactcctactaaatctctcagactcctcagctgtgtcccttcctaggggaggactctcttccctccagtgagcccggtggtcctccctgggatcccctgctccttgtcttccctgccgtccttactgccatccttgttctctactcagaaggaggcagaggctggcctgcccccaatcccctgtagactgaccagatgaattgacctgggctgggcagggcaggcgtgtttgaccagttgtctgggcaccccaggcctcagtccaagttgacacataaagttcaaccgcccccgggcccctttgttgtaatttgtgtatgaataaaacacagcatcccactccaggtatctgagggtccctggaggcaggttttgtgatccctttttacagatgaggatgcggaggtccagttgtcactcacccagatcacactctcatctgctgatgggaggagtatttgatgggatgtgtgagcccggccgtctcccttgggacacatcagctcattaaatttgccagcccctgcctgaaaaagtatttaatttgccttttacaatgcacccattgcaagttaattaactggcaattgaaagttataggtggcattagaatttattaataacattgggaataaatctccctggaattcaattaactgaaaaaaaaaaaa

SEQ ID NO: 734175 - DNA, 458 bp, Homo sapiens
ggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcgctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggg

SEQ ID NO: 734176 - DNA, 1005 bp, Homo sapiens; identical to SEQ ID NO: 309365

SEQ ID NO: 734177 - DNA, 862 bp, Homo sapiens
gaataagccactgaggtcagtcctattattatccccatcttatagatgaagaaaatgaggcaccaggaagtcaaataacttgtcaaaggtcacaagactaggaaatacacaagtagaaatgtttacaattaaggcccaggctgggtttgccctcagttctgctatgcctcgcattatgccccaggaaactttttcccttgtgaaagccaagcttaaaaaaagaaaagccacatttgtaacgtgctctgttcccctgcctatggtgaggatcttcaaacagttatacatggacccagtccccctgccttctccttaatttcttaagtcatttgaaacagatggctgtcatggaaatagaatccagacatgttggtcagagttaaagatcaactaattccatcaaaaatagctcggcatgaaagggaactattcctctggcttagtccatggatgaagactttcaattgctataaagtggttcctttattagacaatgttaccagggaaacaacaggggtttgtttgacttctggggcccacaagtcaacaagagagccccatctaccaaggagcatgtccctgactacccctcagccagcagcaagacatggaccccagtcagggcaggagcagggtttcggcggcgcccagcacaagacattgcccctagagtctcagcccctaccctcgagtaatagatctgcctacctgagactgttgtttgcccaagagctgggtctcagcctgatgggaaccatataaaaaggttcactgacatactgcccacatgttgttctctttcattagatcttagcttccttgtctgctcttcattcttgcagtattcattcaacaaacatta

SEQ ID NO: 734178 - DNA, 806 bp, Homo sapiens
gaataagccactgaggtcagtcctattattatccccatcttatagatgaagaaaatgaggcaccaggaagtcaaataacttgtcaaaggtcacaagactaggaaatacacaagtagaaatgtttacaattaaggcccaggctgggtttgccctcagttctgctatgcctcgcattatgccccaggaaactttttcccttgtgaaagccaagcttaaaaaaagaaaagccacatttgtaacgtgctctgttcccctgcctatggtgaggatcttcaaacagttatacatggacccagtccccctgccttctccttaatttcttaagtcatttgaaacagatggctgtcatggaaatagaatccagacatgttggtcagagttaaagatcaactaattccatcatttcaattgctataaagtggttcctttattagacaatgttaccagggaaacaacaggggtttgtttgacttctggggcccacaagtcaacaagagagccccatctaccaaggagcatgtccctgactacccctcagccagcagcaagacatggaccccagtcagggcaggagcagggtttcggcggcgcccagcacaagacattgcccctagagtctcagcccctaccctcgagtaatagatctgcctacctgagactgttgtttgcccaagagctgggtctcagcctgatgggaaccatataaaaaggttcactgacatactgcccacatgttgttctctttcattagatcttagcttccttgtctgctcttcattcttgcagtattcattcaacaaacatta

SEQ ID NO: 734179 - DNA, 792 bp, Homo sapiens
ttttttttctttttagagatcaggtcttgccatgttgcccaggctgaacgtgaactcctgggctcaagtgattctactgcctcagcttcctgagtagctgggactgtaggtgcatgctaacatttgctttgtgtttttattgttcttattgttaattcaattctgaactttttgccagttatcgaattctcctcttaagattttcagacacaataggtgttttgtaacttttttttttttttgagaaatctctcccagagccttagcatatactccaatttgggaataggctgccatctatggccttgtgtacaggctggcttcacctcaaatcaagggattctcttcggctccctcctgtgttgtatctcttgtttgcaatatcccaccttgtcttctttttaagtttactccctcattttggcagagaaagtccctcagctgctttgtcaggaagagtgtgggagaggtacaaatttttgagactttgtatatacaaaaacttcattctactcttacactagatagtttgcctagagagacagaattctaggccattttcattcaacattctggaggcattattgaattgtcttctggacgctaatgtggctattgagaagtttgaagccactctacttaattctttgtgtgtgactgtttctcctgttctctggaagtttatagaatcttgtttttgttttcagtgctctaaaatgtcacaatgatataacttgctgaaagtctgctttcatccactatgttgtacttaatggacactttccttttgta

SEQ ID NO: 734180 - DNA, 684 bp, Homo sapiens
acaaagactagttagtctattaaaactgtgaatgtgtgtagcaattctgcttgtgaagggaaatacactatttaacatgaaattatactcctgacacaatatgctatatatacaaagacctcataactagtaaattttcaacatgtgagttcagtgactagtaagaatgaataaaaatgaagctcctttagttaatctacgcaagggaacatctatttatagttactaattaaaggactctgtaaagcaggaaaaccatgcatgggtaagtgggtagggcagcaaactgttctgtggatttgggcctcatgacggtttaaaattgccttgcaatttgatctcaccagtggctgacatttgactatagtccatttgccagccaaggtaagtccctacccattgctctctgcagctggccccaagctcctgctggacaggaatgccttaaaggggacccacactgggaggcagttcagaaagagggaaaggcggaggaggtgtaagtaggacaaagaaaagtcaaactacagaggaatcataaagaaaataatagaataaattgagaacccaaggggatgggaaaaaatagcaagcaaggagagtgagaaagaagaaaaggtaatagtgtaagtagaaaaaactgttagtggaaggcaggttaaatttggaaggaaaaatagaaca

SEQ ID NO: 734181 - DNA, 725 bp, Homo sapiens
aaatatattggctcagtaacagaaaaaaaaaatagcccttgattaaaggtttgatctatcccacgtaagaaagattaaaagcaaagctagaaaagatcagatttgtttctaaataacttatctgcgtcctaaaacaaaactaaaaaatttttttaaatacagtaatgtattaaaacatactgaaactcaatacatacagagaaacgaagataagaataagaagtccaagtgcagcggctcatacctgtaatccaagcacttggggaggccaaggcaggggatcacttgaggccacgaatttggggaccagcgtgggcaacacagcagaaccctgtcctttacaaaaaaaaaataaataatttttttcccctttttggtagagacagggttttactgtgttttttcggggggaagaaaaactgatgtctggaactggcagggaacctgaagagtttatgtggtttaccattgtgtctgtgccttggactctttttagcaagtaaaatctaattgagtttaattgaatgtgttcccaaataaaaggcagagattttcagattgggcagagaaagtaaaaccaacatcaaaaaattaatcttcagtcccagcttactcgggaggctaaggtgggaggatcacttgagcccagaagttcaaggttacagtgagctataattgcaccactgcactgtagcttgggtgacagagcaagaccccatctctaa

SEQ ID NO: 734182 - DNA, 842 bp, Homo sapiens
  misc_feature (4)..(4): n is a, c, g, or t
  misc_feature (23)..(23): n is a, c, g, or t
  misc_feature (719)..(719): n is a, c, g, or t
  misc_feature (726)..(727): n is a, c, g, or t
ggtnttcagccctgttgagagtnggagtcggtgtcgatggtcacagctcagtaactcatcgtcaccagcgagtaccacagagcagacacaactgcacttctctgtagagcctccagtcgatactgagagccactggggcgtctgacacccaagggtgcagacattcactccaagtccagagaccgcgccctttctaaggccctgtctcacagtcgccccgtgctcattgtgccggatgtttccacagccacagagacggtgcgtgaaggtgaggtgcagcctagtgcatatgactgacagaaacgtgaagccacagtggacgcctggatgagacacagatcaccttccaaatctgagtgtggccttgggaccaaccaggcagccagggagaaggcagagaccagagggaacccaggtgccctcaatcccagcctcctctatcccagcctcccaatcccagcctccccaatcccagcctcctaatcccagcctcctccatcccaggacccccactcccagcctcccgatcccagcttctctgatcccagcctcccctaaaacccagactctatgaatcccagcctctgaggtgggaactgttagtaaccccactccatggacaagaaagctggggcctggcgaggctaacagactatcctgatggtgtgagggagggatcggcctctgagggctgcttccacccattttcaccagtgggntgcaggnntccaggggccacttttccttgcagtctatgctcattccaagccatcctgcagctccagaagctccggagccgacagcactgacgagaagcgatggagcctgcaatgcagggtgag

SEQ ID NO: 734183 - DNA, 776 bp, Homo sapiens
gtactttatgttgtatcttttagcctaacctttaaatattggattcctaaggtcccttttatcattctgtattctcccttaagaaggtttttatcctctctcattcactgggttatctatttggtgtcacccccaggtaatatctagctcacactttcttcctgagttcaatacctcaaagtatgtttgtatacatgacttacctcatgtgggtgcttcataggtactggaaactcacatttgaaatagaagttatcttcctctcctctaaaatgtcttttaacactgcttctgacttccctgacctcagtatataacattgccattcatctgcctggtccctcaagtgaaaaaacacaaaaaccatcgtatgctcttcctttccctttgttcccctcccctcacatattataagcccctagttcctgctattattaatgtcattaagttctcctaaattcagccatgacccttcccttctgtctcttagctcaaggcttcttccggaacctcatagctgattgtcttcttttgggcattgcttttctcaagtcattttgtacactgcaactagagtgaactttttataaaaggcagcctgatcatctgtcctacttgaaagccccagtagcttcccatttgctcttgggatgaagtcctagtgaagggttatatgctcatctttagttcctctaaacagcttccctgaccctctgcatcttctctgatagatttggtgtgcctttttataagctcctttgtgcttcattacgtac

SEQ ID NO: 734184 - DNA, 2582 bp, Homo sapiens
tgccctctcccgatgtcagttaccaggctttgctaataaaacgtctctcccggctcttccagagagccagccgcagagtctctgccgtctccccgtgcgctcaagcacaagcccccaactaaaagccttgtctggaaaatctgcttggtgccataacagattatctggtgagccaggtaggagcacaaggagtaatttccctccctgcaggggaggcttgtgagcctgcgagccggagggaggccccactgattcagcgctgccaccgcgactggcgagttttcctctagtctcgcgactggacactggtcagtagaacctggacctgctgtaaggctgaagaagaaaaagaaaccatccaagctggcactcggttttggggagttctcttcactgctcacgccggccctcttgtgtgacctgtactgttgtgctgtgtggggctgggagccaactctcttttcgtcgcctgacacctgtgcttgcaccctgcccctggtcctttaataagacaagcagacacaggggctacagtcatgggcaatgccccaggcatcttccaagactcacacctgggatgtatcatttctaaatggaaggaatccaaatcagatggtttaaagaaaaagaaactccagcctgggaaacataggaagactccacctctacaaaaaacaggaaaaatgagccgggtgtgggggtgccttcctggggtctcagctactcagaaggctaaagtgaggatcgcttaagtccaggaggttgaggctgcagtgagttgtggtaataccatagcactccaacctgggcaatggagtgagaccctgcctcaaaatcaaattttttttttaattaaaaaaaaagaaactgattttcctctgtaatacaacctgccctagtacacattagatcaagaaaaatggccatgggcagaagtggatcttctagttttaacactatcttaccgcccgacctattctgtgaatggacagagaaatggggagagatacctagctacaagcttttatgaagttatgctaggacccagagctactggattcttgtcaggtgtgtgtggcccctatttccaggttcctcctgaaggaacctgaagaagcggacctccacagcctcaggccccgagcactccctccctaccctaagcaggcctcctggggaggggagcccctgtgctgtccccaacagcgctccaatcggactccaaacaggcaccctcttttgcttccccactggcccagggctgttttcccctcagagaaatggatggaaacgggggagtgacaaggatccaagttcctttttttggtggtggatctaggactatgtaaaaaacactttggtagattttcagaggatcctggtaagtttagagatgaatttgttaaactaaatcttgccttttcattgacgtggcaggatgttatggtcactttgcagtactgatgaaaagcaacacatatttggaaaggctaaggaatatgccaatagccaggtggtcactaaagaccaatatgcagtcatctgtttagggggagatgcggtcccaggcatagtctccacgtgagtgagactatggagaaaacctagaaaaagctagaatgagccactttgtcacctgcctgactgaaggaagaaggaaatgtatagtaaaacctgtacactatgacagggtcaagaaaattacccagagaaagaaggagatcccagtagtcttcctcaatcgagtccctgaggcccttgggaaatgcacccatgcagacccagaggcagcagaggggaagcatcgcgtgccatgcattttatccttcagtcagctccggacattagaaggaaattacagaaaatttggaggccagaccccagaccctgctgttgactttggcagaggcggcttttaaggttttcaataacggacaggacacagatggcaggtaagaagaggagactgaccaagacagcacagcttctggctgccctaattcatccaccatcttcagggtgaccctaggattctcaggagaccaactaatcgaagacagccaaccttggatggagccaatgtgcctactgcaggatggagggtgtcactggaagagaggctgccctgacctccttaaaacaggacagccggcaggcaaccctggccagccgccactcctcaccaagctttcagatgagattgatacacaccgcctgacagcaccctggctctgactgcagcacactccatcgtcatcacaccacggagcctcaggtcacccttgatgtggcagttctaggaactggccttaggaaatctaactatgaaaccaaggttatggagtatcccacctcaggaaggaacactgaacaactgattgacagtcttcttgccgccagccagaccaccaagtggcccattaaccaagagaaccagcgcaaccagatacgctgacccgcatctcctacctctcatgtgctttgcccagcccagcctgcataccttactcatgatgtcaattcccaagtttcgctaataaaaacatctctgcaagcctcttcagggagccaacaagacagtc

SEQ ID NO: 734185 - DNA, 7971 bp, Homo sapiens
tgccctctcccgatgtcagttaccaggctttgctaataaaacgtctctcccggctcttccagagagccagccgcagagtctctgccgtctccccgtgcgctcaagcacaagcccccaactaaaagccttgtctggaaaatctgcttggtgccataacagattatctggtgagccaggtaggagcacaaggagtaatttccctccctgcaggggaggcttgtgagcctgcgagccggagggaggccccactgattcagcgctgccaccgcgactggcgagttttcctctagtctcgcgactggacactggtcagtagaacctggacctgctgtaaggctgaagaagaaaaagaaaccatccaagctggcactcggttttggggagttctcttcactgctcacgccggccctcttgtgtgacctgtactgttgtgctgtgtggggctgggagccaactctcttttcgtcgcctgacacctgtgcttgcaccctgcccctggtcctttaataagacaagcagacacaggggctacagtcatgggcaatgccccaggcatcttccaagactcacacctgggatgtatcatttctaaatggaaggaatccaaatcagatggtttaaagaaaaagaaactccagcctgggaaacataggaagactccacctctacaaaaaacaggaaaaatgagccgggtgtgggggtgccttcctggggtctcagctactcagaaggctaaagtgaggatcgcttaagtccaggaggttgaggctgcagtgagttgtggtaataccatagcactccaacctgggcaatggagtgagaccctgcctcaaaatcaaattttttttttaattaaaaaaaaagaaactgattttcctctgtaatacaacctgccctagtacacattagatcaagaaaaatggccatgggcagaagtggatcttctagttttaacactatcttaccgcccgacctattctgtgaatggacagagaaatggggagagatacctagctacaagcttttatgaagttatgctaggacccagagctactggattcttgtcaggtgtgtgtggcccctatttccaggttcctcctgaaggaacctgaagaagcggacctccacagcctcaggccccgagcactccctccctaccctaagcaggcctcctggggaggggagcccctgtgctgtccccaacagcgctccaatcggactccaaacaggcaccctcttttgcttccccactggcccagggctgttttcccctcagagaaatggatggaaacgggggagtgacaaggatccaagttcctttttttggtggtggatctaggactatgtaaaaaacactttggtagattttcagaggatcctggtaagtttagagatgaatttgttaaactaaatcttgccttttcattgacgtggcaggatgttatggtcactttgcagtactgatgaaaagcaacacatatttggaaaggctaaggaatatgccaatagccaggtggtcactaaagaccaatatgcagtcatctgtttagggggagatgcggtcccaggcatagtctccacgtgagtgagactatggagaaaacctagaaaaagctagaatgagccactttgtcacctgcctgactgaaggaagaaggaaatgtatagtaaaacctgtacactatgacagggtcaagaaaattacccagagaaagaaggagatcccagtagtcttcctcaatcgagtccctgaggcccttgggaaatgcacccatgcagacccagaggcagcagaggggaagcatcgcgtgccatgcattttatccttcagtcagctccggacattagaaggaaattacagaaaatttggaggccagaccccagaccctgctgttgactttggcagaggcggcttttaaggttttcaataacggacaggacacagatggcaggtaagaagaggagactgaccaagacagcacagcttctggctgccctaattcatccaccatcttcagggtgaccctaggattctcaggagaccaactaatcgaagacagccaaccttggatggagccaatgtgcctactgcaggatggagggtgtcactggaagagaggctgccctgacctccttaaaacaggacagccggcaggcaaccctggccagccgccactcctcaccaagctttcagatgagattgatacacaccgcctgacagcaccctggctctgactgcagcacactccatcgtcatcacaccacggagcctcaggtcacccttgatgtggcaggtaggaaaacagttcctcgtggacagcagagctgcctgctcggtcctgacccagcctatttgcctcctctccaattgcaattgcagggtaatgggaatagacaggtgtcctaaggtaagaaaatttactttccctcttgcttgtgaggccatgtctaggcttttttctcctcatttctgtatgccccccggaatgtcctactccattgctgggtagagacttattaagcaaaatgggagccaccatctccctggaagaggacagactgcaggtagaggcagagccagaacagggaatccacctgctagcactcttaaatggacaggaacttgagacccaaaacatacccaaagaaagcaaggatcacatcaccccttccctatcggacacttcagtcctaggacaggctaataaagttccgccagtaaagacagacctgaagcctgggatgggctatccatggaggaaatcatacctcctaaaacctgtggcactgaatggggttcagccattactccacaaattcctatagcaagggctaaaccctgccagtccccaggcaacacctcggtcctccctgttaaaaagcctaatggagaatatcagtttgtgtaggacttgaagggggttaatgaggcagtcattcccatccacccaacactggtcccaagcttgtctgtgctcagatacctggagatgctcagtttttcactctactacacttcaaggatgctttcttttgtgtagccctctccacccagaatccctgtatctttttgctttgaatggagaaatctctgatacccagaaagccacatagtacacatggactgtgcttccccagggcttctgggaaggcccccacctttttgggaatgcagggagctaagcctacagaatgggacttttattacaatatgtggatgacttgttcattgtcagccaaacatggcaggattcagattttaatatcattaaaaccttgaatttcctggctgagcggtgatacaaggtcagccccatccaaggcccagatttctttacagaagttccgatatctggggttcattctgaccccaggagcccgaacactagttgtggactggaaaaagcaatcacttcattgctggtcccacaaacaaaaaggcagccccagggtttcttgggaatggtgggcttctgtagtatttggattccaaattatggcctgacggctaaacccctatgtgagacccaaaagggggaagaaagagagcccttgtactgggagaagaaatgtcaactatcttttgaacctctaaaaactgagctgggtcaagcccttgtccttggactccctgagaaaaaccacttaccttgtatgttcgtgagagactaggaatagctttgggagtcttaactcaaaggttaggacctgttcagaagccagtggctcatttttcgaaacagacaaatccagttgcacagaagcggcctggctgctggagggcagtggcagccactgccctgctgtttagtgaagcatctaagctgacacagggacaatatacagaagctatgactccccaccaggttcagactgggttagaagtcaagggacaccattggctcactgcagggaggctgaccaactaccaagctctcttattagacaccctggatattactttaagggtatgtcagactttgaacacagcaacctcactcccaaccacagatgatgaggactcacagcatcaatgcacagggcccacaaaacagactccagcaggcctagcttgtgagataagcctcttgagaatgcaaagacggaatgatatcctgatggcagtagctttgtggagggagacccaaaaggcaggacatgcagtagtaagcctgaaggagactacagaaactaaagcccttcctccccaaaatggcacaaaaagcagcactagaggccttaacagagcctcacaactgggagaaagggagggagtaaatttatacaccaactcaaagtataggtttctcctgctgtgtgcccatgcagccatatggaaggaaaagggaatgttaacagttaaaaattccccaggcaaacgtaaggatccaatccaacttctcctggaagcggcacaacttccctgccaggtggcagtcattcactgcaaaggccaccagagggactggtccctcatcagccaaggaaatagggccacaaaacaggcaacctggttataggaatccagcaatgtgttggccttaatgacagaccctaccaaccttcctaatcacctacaatactcacaacaagagcaagaggaagctaaggggcaggggtaccaggaaaacagtgctggatggttcacagatggtgacaagttttattccaggaactgaccagttgaaagttactaagcatctccatgatgccactcattaatggagagatgttttatggaattctgtccataaaatattcaccagaaagaaactaagaaaaagtgtaaaacaagtaacctttgtcagtgaattgtgttcccgaaataatccccacacccatccaattcccccttcttgacttaaactggttcaacacaggggaacttatctgggagaagactggcaggttgttttaacccaaatgactccaaatctagggtacaaatatctcctggtgtttgtggatacttttactggacgggtcaagggtttccctacctgtacagaaaaagcagtagaagtctgtaaaccttcactaaaggaagtaatttctcaatttggactccccaagtcccctcagagtggtaacaggctctccttcatgggtaagattactcagagcctctccacaaccttaggaatagattatgaactggcaccccaatcatcagggaaagttaagatgaaccatacacttgagacgactctagccaaactctttcaggagatgcacgagtcctgggttaagatgctcccagtcttctcagggtccgcagggccccttcgtgcagcctaagacttagttcttctcagatgatctaccagaggcctttcctcaccactgacctcctgttaggtgaagaattacataaaaaattacagtatcgatttaggacagattcaaaaggtgacttcagaatatggaaacaaaatcctgccagtccccactaaggatgggaaaacccctttacaagttaatccaggggaccaagtcctcctaaaggcttgaagggcaggctccccggaggaccaccccttgcttaaatgggagggcccttactgggtgatcctgaccactccaactgcagccaactcacaaggaatcactagctgggtacacctctcccgatcagaaatgctttctcctaaatgtttccagactcgcccagatggcccattttactcctgaaaacctgtggaagacctcaaattcaggagagccaattcatcatcggagaagtaatgtggttagagatcttgagtccaatacttttccttgtattactaattggtttactattattctgttgctttgctcagcctcctccctcaggtaaagacttcgtttgtccctgctgggtataaagatgctactctttactttgttcctactcctccccatcagggcacagggtaggctaggcctactaaaatgagaaacaaactctcttgacaacctttccggcattatagcttcaggtaataatttgtccaactgctgggtgtgctaccatcatccccaggctcagaggggctgcctcttgcactccctaaaagctcaactaccaacttcacaaaagaggtatggaaacctaaaataacctctgcacctcttatggtggacctaagtgtctccctttcctttgaatgtataaacctcattgggctgctaaatgctttggtcaccaaaaagggtggaaaaaagagaagttggactgcctactttgaaatcccaccgggttttctcttagcagtaaagaaaaaccctaatcaaacttgggctcaggaaggctatcttttcccccatgccaaaacagtcatacctctctccacagcttagctgctcacctgaactcctctcgccttgtgtaagtttgtgcacccatggggtattctgttcctttgtggacacccagactgccatctgatcaacagctacccttcagccaatttcacctttctgttacttgcactagcgtgcccttgtgtggataatgtacaacgcaataaggaatgcatgttaggtactttaagtcccagtagaataacagttcataatatcacacatgtggtgaaatctaaaaaggcaatagggctaattttggcaggagttggaatagccccttgggatggctttgcatactgtcagacagctttgagaaactttcaaacccttgaaacactggcaactagtacaggcagagccataaaaggacatcaagcctccctgcactccctagccaatgctgtcttggataacagatttgccctggaatatcttctggctgaacaagggcgggtatgcacagtaataaaccacatctgttgttcttacattaacagttcaggattggctaaactgcaagttcaaaagatttaccaagaccaggcacaatggttcatgcctgtaatcccagcactttgggaggccaaggtgggtgggtcgtttgagcctaagagtttgagaccagcctgggcaacatggctaaaccccatctctacaaaattacaaaaaaagaaaaaaaaattaggtggccttggtggcatgtgcctttattcccagctactcaggaggctgaggtgggaggattgcctgagcccagaaggttgaggctgcagtaagccatgatggcaccactgcactcctacctggatgacagagtgagaccctgtctccaaaagaaaataaaagtaaagattcaccaagaggctacctggctacataatcgtaatgactctactgctcaaaccatctggggctccatcagtggatacctacaaagtatgacatggtttttacctttcttcggaccctaagtggtcatttaattgctattacttttggcgtattgtgtttttaaccttttggtaaagtttgtgtctttcaggtttcaatagctccaagtcaagctaatgatggcccaagaattccaacccataacatcccaggagcaccccagtccctacaggtctttaggacagccagtgagagatttccccaccccctaaagttaggcagggacgacatccctgttcagcaggaagtcgcttcagaagatgagatcttcagccctttctccttaagaatagagggtgaaatctctcagggggaaatagagatagaacagaaatggaatggggttgcttcttcataatacttaaccatgccttctacttaaagttctaggaactggccttaggaaatctaactatgaaaccaaggttatggagtatcccacctcaggaaggaacactgaacaactgattgacagtcttcttgccgccagccagaccaccaagtggcccattaaccaagagaaccagcgcaaccagatacgctgacccgcatctcctacctctcatgtgctttgcccagcccagcctgcataccttactcatgatgtcaattcccaagtttcgctaataaaaacatctctgcaagcctcttcagggagccaacaagacagtc

SEQ ID NO: 734186 - DNA, 511 bp, Homo sapiens
tttcctgctactttcctgcttggtgtcttgcctttgaggtgatgttttcctcagacccctctgtgtccttcttgcttcctgggggacctttgtggaactagaaaatagctgtttactagcctggagcaaggagcctgagtggtgagccggctgcataaggaaggcacagcagctcatgcttccctaatgcttcactaaacatgcaagacacaaaaggacccagagggctccagcaagggtctggggaccgaacgtctaagcttggaaactggctggacttgtatgggtaaaaccaagagtttttgtcttagctctcccgcctcacagctttgaactgggggtggctcttggtctgcatttcacatgcacggcacctggagaagtgctgctagccctggcacctctgtggggttctggccctggcggagactttgccggccacggcttctccaataggttgctggtggcatctccagcaattggtggtcattgagttggagaagaagaaaag

SEQ ID NO: 734187 - DNA, 642 bp, Homo sapiens
ggcacgagggattgaaagcactctgcagataagttactctgtatttcttttttttttttcactttattttttatttttatagacacagggtctcattgtgttgcccgggctggtctcgaactcccaggctcaagtgatcctcccacctcagcctcccaaagtgctgggataacaagtgtaagtcaccacacccagcctctgatttcttttctaaggggatgacctatttctgtttataatccaaaatttatcagccttggccctactgatattttgtactgcgtaattggagggaatgtcctgtggcagtgtagggtgtttgggcagtatctctgggccctccccactacatggccaatagcaccctcccagaccaaatgtcctctgggggacaaaattgccccttgttaagaaccactgttttaatctatgtgtaacacaaatttcaaaacactttggtgagtacatagcatggattatgattttttaaaaactttgtttctttttaagctgattctattctagtcatggtcatattttttaaatctgtagcttttttcctactgaagagacttttaaaaaacaagaatatgaaagtcttctgtgtccaccatcaggccaaactataatgctttaagagaa

SEQ ID NO: 734188 - DNA, 536 bp, Homo sapiens
  misc_feature (1)..(1): n is a, c, g, or t
  misc_feature (21)..(21): n is a, c, g, or t
  misc_feature (32)..(32): n is a, c, g, or t
  misc_feature (533)..(533): n is a, c, g, or t
nttcggcacagcgggaggcgnaggttgcagtnagccgagatcaagccactgactccagcctggcaacaaagcaagactctgtctcaaagaaagaaggaaagaaagagagaggagagggagagagaaagaggaaggaaaggaaggaaggaaggaaggaaggaagcaagcatcccatcactgagacttaataattatcaacccatggttttttgaatttcacgcacatcctcactcacttccccaccccacttcacatcaagctttggtaaatctcagacatcacagtgtttttttctttgtttgtttgtattttgagatgggagtctcacttctgtcatgcggggagtgttagtgggctcagtctcgggcttcactggcaagctttcgcctcccaggagaatcacttgatcccgggaggcggaggttgcagtgagccgagatcaagccactgcactccagcctgggcaacaaagcaagctctgtctcaaagaaagaaggaaagaaagagagaggagagggagagagaaagaggntgg

SEQ ID NO: 734189 - DNA, 371 bp, Homo sapiens
  misc_feature (1)..(1): n is a, c, g, or t
  misc_feature (21)..(21): n is a, c, g, or t
  misc_feature (32)..(32): n is a, c, g, or t
nttcggcacagcgggaggcgnaggttgcagtnagccgagatcaagccactgactccagcctggcaacaaagcaagactctgtctcaaagaaagaaggaaagaaagagagaggagagggagagagaaagaggaaggaaaggaaggaaggaaggaaggaaggaagcaagcatcccatcactgagacttaataattatcaacccatggttttttgaatttcacgcacatcctcactcacttccccaccatgcctgacctggtatggtattttgttaaacagaacctcaggccagacagatcttctgtgcatggatgtagtctatattggaagtaccgtcgaggctgaaggcatcgtggctgtgacgcccgacac

SEQ ID NO: 734190 - DNA, 723 bp, Homo sapiens
tggatccagtgtatgctgcttgggtgatgggtgcgccaaaatctcagaaaccaccactaaagaacttattcatgtaaccaaggaccacctgttaccccaaaagctattgaaattttttaaaaaagaaaattggaatagtatactttcatttcctctctcccagccagatacttctgggatttgtaggattatagttttctttacatttaggaaagttttgggccattctttttttatttttctgtctctctttttccctctttgggggacttattcctccttgaagttttctcataggttcactgatgtctcaaatttatgaatcttctctttgggtgatgtctaatctgtgttcacttcccatccattttagctttcattcctgacactgtaatttgaatctctacaagtgtagtttgctttaaagaaaaatcttccggccgggcgcggtggctcaagcctgtaatcccagcactttgggaggccgaggtgggcggatcacgaggtcaggagatggagaccatcctggctaacacggtgaaacaccatctctactaaaaatacaaaaaaaattagccgggcgcggtggcaggcgcctgtagtcccagctattcgggagcctgaggcaggagaatggcgtgaacccgggaggcggagcttgcagtgagccgagatcaagccactgcactccagcctgggcgacacagcgaagactccgtctca

SEQ ID NO: 734191 - DNA, 942 bp, Homo sapiens
tatatcattattttgaatggaggcatggtcatttggaaagtgacaaaatcataagaatcgactgcattagaagcccactttatttttttcattattttttgtcgaaacattctctatatttaatttcaattttataacagattacaggaagatgcttaagaaacaagtacaacatttgtttcagtatgtctttaaatgaaagacttttaagtatgtaagcaactatataataaaaggtttccaaacgcagcctgtaagaaatcaggcaaattttactataagcaataaaccattccgagctttccagacagtgtaccagtagctgtaccagtgggcaataacctttaaccaaacaaaaacaaacaaacaaacaaacaaaagcactttgcaatttgttgctgcaaaatggggagaaaaaaagagtatataaacttgatggaatcacaactgtcaatataatttaagggaaaataaagtcgataaggttgatggtgtctattgtttggaaagtcgaattcggctatttgcttggggctctagagaccacaccactgaataaacaaaactctgcagagtctagctatccgccaacagggggtgccgtccaaattcatggcaaataaagggcatttggtgctcaccattcacaacaggcgggcatttatgtggatgaagtacaatttcttcagcaagctcagcaaaaactcttaaggggcaaatatgaactctgcattttaagaaaaatagaaaacggaaacacaaaatcctaaaaagtatatgaaggctctgcattagcacactggcatcaaaccacacatccacagcacatcctaattctatgggaaacaatccttgcttatcggaggtgcatatctaaattcaatagcttaccaatatattcttgggagtaggccaaaaggaaacagaaaacccacattaaaa

SEQ ID NO: 734192 - DNA, 919 bp, Homo sapiens
tgtataaagaatgctttaagttgtcttctccgactgccccttattcacttaaagacagactcatatgactggggcagtgacttgtagagcttctggtcctttgcaaataccatgctgtcctgtcttaaaagagctgactaaattaaaaaaaaatccacctcaaaaagaagtgaatggctgttatgatcacctcagaagtatctcagggcaaatatacacacacaccccttcatctgacacctgtggcttttaaaaagaaagccagataacggatagccatttaatcagtttgtatccacacaagcacttctccgatttccctcatgcattaggtaatgacactctcccctgagattgatatgtatattataattaataactagcgcagcgtgttctccaaaggggcagctgcaggaggaataccacagcctctgctgtgacccgcagacctcagtgggagggacatgggacatggtggctcgcactgtgttgaccagcagcccctgttcattgcatggctgggtctggttcctacctagtgggtcaaggctgatatattaaagttctgatgttttgtctcaaaaagaccaatatgacctagttggagtacgtatatataaatgtgtatgtgtatgtagcattctatattcacaagcctttaagtgatttttctaggaattaataagaagtaaaggccaggcacagtggctgcacttgtaatcctagtgctttgggaggctgaggcaggaggattgcttggggtcaggagtttaagaccagcctgggtagcatagctagactctatcgctacaaaaaaatgaaaatatttagctggccgtggtggcacatgcctttagtcccagttacgtcactccatacactccagcctgggtgacagagtaagaccctgtttctttaa

SEQ ID NO: 734193 - DNA, 1802 bp, Homo sapiens; identical to SEQ ID NO: 48087

SEQ ID NO: 734194 - DNA, 5538 bp, Homo sapiens; identical to SEQ ID NO: 54853

SEQ ID NO: 734195 - DNA, 745 bp, Homo sapiens
tcatgcagaaaagtcagtactgagcctggaggatccttgagctcttcatcttaaccttctccttgaagtgccaaaattgctggccagcccctcagagcaggagcagccatccttgtcctgacagtccacccagggcagcagtgagcctccctgtgtgggatgggaccaaggcttctgtctgattcccaaccctatccagccccctctctccagcccttcccacctgtttgcctctacccgcgtcagagttctgacagtctaactctctcccacactactgctctggaccttgacgcagcaaagcagtcacagtcgtcaacccactggaggacacatagcctggagcccaggtgaggcttgcagactcagtagcttggagctatcagatgggccatcctgcattactgcaagccctgcccagaggctgagtgaaggccatcaggctgaaccgagccacagctctgaaagaatgccgcagctcagtggctcccagctttgccgcacctcacaatcacctggggagctttgaaaattcccactgcctgggctgcacaccctaccagtgaaatcagaatatctcagggtgggagtcaggcagcagtcgttttggttttgttttttcttttaaagaacccaggtgatgtaatcccagcactttgggaggctgaggcaggcggatcacaaggtcagcagttcgagaccagcctggccaatatggcgaaaccccgtctctactaaaaaataa

SEQ ID NO: 734196 - DNA, 557 bp, Homo sapiens
tggactacaggagagaaaaaaaagaagggagggatacagaagggattcatatagtgagaagaccatgctctctccaagccagctttccagaattcccttcaatgtgccttgggagtctcacctccttccttgccatagtcccggcagcctccatggtgccgaggtagaagtaggtcctcaggtccctttaactgaattgagtcatggctcaccaccactaccaccagcaaacgccctctcttcttgctgccgcagcacctagggatttcctattccttctcctcaccagctaatcacaatctacctatagcctcagtagggggtctctatgcctgatgcctccattcacacctctggagctcctctcctgccctcttctgctgtggtacattggcctctcctgctcctgtccatcttcacaactgtcatttgcccatccctaaatccatcatccttgcccaaaagattcccactgcccagggaaggagtcaggaagaacaggaagaactgtaagaagatacatagagcatgtttggaggcctaaagaaataaagtta

SEQ ID NO: 734197 - DNA, 435 bp, Homo sapiens
  misc_feature (12)..(12): n is a, c, g, or t
  misc_feature (420)..(420): n is a, c, g, or t
ccggaaaatatnccatatttccgagtaggaaagttggttttaaccggaagtgtaagaggaaagattatggcccttaaatggatttttttttccccttaatgtattagggcaaaatccctcaatgatgatacctgctctcaaagaatataaaattgatgagaaaaactttgtggtggttatggtgaccaaagtaagtttcaacctcattctgtatatctttatgcatgtaggtctttttaaaaatgatgatcacaagtccacacaatggacacagtttatacacatccatagtggtgtacacttaactactatgaaaggtttttaagaatttaccttaagtgaaacataaagttattaatgttttacattaattacacattaaactataatatagttttaataaaattttatgtaaattanaacaaaagaaaaaaa

SEQ ID NO: 734198 - DNA, 1311 bp, Homo sapiens
gaggccgcagaccctgcccagcagccagcacctggcacaggccctgcagccgagctgtacagtggcaccatgcaggtcaccctgaagaccctccagccgcagaccttgacctgcaagatagacattgaccccgaggagacagtgaaagcactgaaagagaagacggaatctgaaaaggggaaagttgcctctctggtagcaggtcaaacattaatttatgcaggcaaaatccctcaatgatgatacctgctctcaaagaatataaaattgatgagaaaaactttgtggtggttatggtgaccgaacccaaagcagtgtccacaccagcactagctacaactcagcagtcagctcctgccagcactacagcagttacttcctccacaacaacaactgtggctcaggctccaacccctgtccctgctttggctccccctttcacacctgcattcatcactccagtatcagtgacagtgtcctctgaacctgcaactgctagtgcaactaaacaagagaaacctgcagaaaagccagcagagacaccagtggctactagcctgacatcaactcatagtacatcaggagattcttcttggtcaaacctttttgaagatgcaacgagtgcacttgtgatgggtcagtcttacgataatatggtaactgagatcatgtcaatgggctatgaacgagagcaagtaattgcagccccaagagccagttccaacaaccctgacagggcagtggagtaccttttaatgggaatccctggagataaagtcaggttgtggttgacccccaccaagcagctagtactggggctcctcagtcttcaacagtggctgcagctgcagcaactacgacagcaacaactacagcaacctggcttcccaagagtggcttgcaaaaactacctttacatttttactgaattcactcttcaacaagttctagaatggcatctacgcctgccaattcacaaaaactgcttttgtaagaccatcaacaaccttcatggtaccaatttcaaagatccattttctgaccttatctttattgaccatctaacggcatctagtgatatctttaatgaaataagacccaattctctaaaattggctgatgcaaagaatctccaaatgggagagaggcggttgtgcctgtaaacttctctccattcccaagatgcatatttatttcctttgggagacttcccagtaaccatatgccacacagaagcccctgttccttctcttctctaacttctagttcagatgtggtggacttatctctcagtactcttaattcagatgt

SEQ ID NO: 734199 - DNA, 456 bp, Homo sapiens
ccagaaactggaagctctccttgcatttttattggttttgctttatttgaagtttgtttttgtccattttacttcatggcttttatcagtgtatctggtgtgtcatttattgctctttatcttgatttttttaactttttaaaaatttgcaaaatctatgaaagtataaatcagtataataaaactccttggatgggcacagtggtttatgcttgtaaccccagcactttgggaggtcgaggcaggaggatctcttgagcccaggagtttgagaccagcctgggcaacgtgctgaaaccccatctctacaaaaaatacaaaaattacctgggtgtggtggtgtgcacctgtacccgagctacccgggaggctgaggtggagaatcacctgagcctggggaggtagaggctgcagtgagccatgatcacaccactgcactgcagcctaggcaacaga

SEQ ID NO: 734200 - DNA, 715 bp, Homo sapiens
gcagcaaaggatgaagaagggcaaaatgatgaaaggtgaggtggaaagaggttatgagatggtaaagaaaagttaacttctggcacttgattgccacttccgtcaggctggtcctgcctctctcccttgccttctgattgtttcatttcctgtttatttgatcatatctgaattagttcactggttagcctcttccttagttcccacttccttaccaaagccctaattatatttcctcttgtttgccttttctctcctactcttctctaacatctgcagccacactctccattcactccatgctgacaaggcagtggcaaacacttttctctgctgccagccactccactgttgactggattgctgccagccccaggcaaacctgtgaagttgtttcatactctgcttctctttgagtgcctccttctctccttcctcttcctttctgggctccagtctttctcttcacttgtgcttgtcagaacctccctgtgatactgcctccaggcatttcccccatgttggctcaccgcactattatctttgcttatcaacttgcattcagctggctggcatgtttcaaaaccacactgccctcccaggcctgtgtgccttttgagaaagaccagtgctggatgagcctctagtaatgacaacattttagttgttagtggtataatacggaagagatattttgcacaggctgctttggaga

SEQ ID NO: 734201 - DNA, 425 bp, Homo sapiens
  misc_feature (6)..(6): n is a, c, g, or t
  misc_feature (76)..(76): n is a, c, g, or t
atcccnatttccgagtagaaaggtggtttaacctgaagggtaagagaaagattatggcccctaaatgatttttttntcctcctaatggtattagggcaaaatccctcaatgatggatacctgctcctcaaagaatataaaattgatgagaaaaactttgtggtggttatggtgacccaaagtaagtttcaacctcattctgtatatctttatgcatgtaggtctttttaaaaatgatgatcacaagtccacacaatggacacagtttatacacatccatagtggtgtacacttaactactatgaaaggtttttaagaatttaccttaagtgaaacataaagttattaatgttttacattaattacacattaaactataatatagttttaataaaattttatgtaaattaaaacaaaagaaaaaaa

SEQ ID NO: 734202 - DNA, 2150 bp, Homo sapiens
catcctggagaagatatactgtgttcactattgaaatgaaaccataaagctagagttaggaagattgaagaaatgaaaaaggagctcacatgattttgtctcaggagaggctcttccaggattctttggagatatggtagattccatagctggagcagggaaaggacaggatgagcctgtgggtgtagaaaggaagggagtgcttgaaagatgatgaggagatgtcagcaggtcacagaaaccctctgaaggaggctccaactggccaggctggggacaatttgggccccaaaataatgacagtaacaaattgtaactcattgaatgaaataggaatccatacattggtaattatataaataagggaataaaaccatgatgcaaaaagggatgtttatgtcatcacgcaaaatatgttcacagaaaatatgtactaattaaaagagggaaaagagtaactttacagtggatgaagcctggcaatcatcactttaagcaagtggtcagagttaatattatcagtaatggtcaaatcaaaaccatatgcaagaagactctaaaatgcaagaagactcctgaagtacttcttaccaaagatgtagaacttaaattcagtcataacaatacatgagacaaacccaagttagagcacagtctgcaaaataactggcctgtaatcttcaaatgcatcaagatcatgaaagacaaggaaagagtgaagagctgctccagttggaagagacttaaaactaaatgcaatgtatgatcctagattggatctttttgctctaaggacattaatgggccagttagtgatatttgaaggggatccgagggttccattgtagtaatatatcagtgttaatttttaaatttttattaggttgggattattttggaaaataccattattcatagcgaatacaaagtagaatatttggggatgataatgcatgattacaacaaatgtttcaggagaaatatgatctttgtagtggtcttgcaacttttctgtaagtctgaaattgtttatgcataaaaggttaaaaaaaggttaaattttgtttttataactaataatggattagggtcatgtgaaagtactttagaggaaatgagacttttgagaacatcatccctgaagacgttgaaacactgagttacctcatggataatttaatagggtatgcagctgatttttctaccttaatttcttgtttgcagtatctacccatacttagaattgtctggtgttaaaatatgcccactgggactttcatgaaattcttttgattttctagaaaattcagtttcaaaggattttttaaatagatattttaagtttggtgtcaacttagataaaatctgtttggagtcccagtgtaagttttagtaatgtgtccaatctgtttattgaaatagtataactttagaatactttctttggagagatgaagattggtatgttatagttcaattcaaagttgttctttctattatgatctattttataattcataaaatctatcttatgattgtcatcataagtgcaatttgttttttgccccattctacctcagaaactaagtatctgggcatcaataacaattggtagtagtgtttgctgctaagccaagtttcaccagtacagtgtggaattattttattgttttttctgtgaacattgtatctgctgttactaggttattgtgaggtattgggccttcatagaaattgcctggaacccttgttcactaaagcctgttacactttttattctctgtgcgtgtaatcagagacttattgatactgacacattcaaggggcattattgatcatttagattgctctaagacctaaggagtcttggccggatgcggtgcctcacgcctgtaatcccagcactatgggaggccgaggcgggtggatcacctgaggtcaggagttcgagatcagcctggccaacatggtgaaaccccgtctctactaaaaatgcgaaaattagctgggcatggtggcgggcgcctgtgattccagctactcgggaggctgagacaggagaatcgcctgaacccgggaggcagaggttgcagtgagccaagactgtgccattgcattccggcctgggtaacagagcgagactccatctc

SEQ ID NO: 734203 - DNA, 422 bp, Homo sapiens
cgtttccagaatcacttagcttctttggctggatgaagcactagccatctcttgctttgacagggctttcctaacttcacaattgttgccattcacagtatgatatttctgaatgacagtcttatccacggagttgtggtcgtcaaaggttacaaaggcaaagccccttttcttgccactgcctcggtcagtcatgatttcaatcacttcagtttttcagaactgtttaaaataatctcttaggtgatgttctttagtgtcttctttaatgccaccaacaaatatctttttcacagttaagtgggcacctggtctttaagaatcttctgttgagacagctctctttggttccacaagtcttctgttcaccttgtgtgggccttgcatttcatgggctgcatcctccacctccacagtggcat

SEQ ID NO: 734204 - DNA, 753 bp, Homo sapiens; identical to SEQ ID NO: 54126

SEQ ID NO: 734205 - DNA, 329 bp, Homo sapiens
ctaatgttaaatgggtgtcttagtccattcaaactgctataaaaatataccttagattggataattcatgaacaaaatttatttatcttggctgggaagttcaagatcaaggccccagcagattcagtgtctggagagggcccaccctgctccacagatggtgccttgttgctgtgctctcacatggaagaaggggcaaggcaattcctttcaacctcttttataaggccactaatcccatttatgaaggcaaagatctcaaaacttaatcattttccaatgtgctgcccccctcttaatactcaccaataaattctaataaactgtcc

SEQ ID NO: 734206 - DNA, 2823 bp, Homo sapiens
agtggagtcaaattaggagagagtgcaatgtgatgtcactgaagaagctcaagcaaatgagaagttgcttacatgcagagaatgaattgtatgtggatgggggttgggggaagcgagggaagagtagagcaggggaagcagtgaagaggcttccaggaattgggggcgggaggctttcagctccaacacacctgcatcgcctcgtctggctgtatgcacgaccctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgttgctgatgccatggtcagctgtctgtcttcctggtccggcttggaccagtgtctcccaggcagacagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacggagattttgtgaagtaccagtgccaccccgggtacaccttggtggggaccgacattctgacttgcaagctcagttccccagttgccagtttgagggttcctcccccaacatgtgaagcacaatgccccagcaaatgaagtccggactggatcatcgggagtcattcctcagtccagggtatccgggtaattattttaactcccagacttgctcttggagtattaaagtggaaccaaactacaacattaccatctttgtggacacatttcaaagtgaaaagcagtttgatgcactggaagtgtttgatggtaagtttctttaatctttgtagagcagtgacctcggcatcattgataaaaacactattacaatgttttagtaacataaagactggaatatattcttgagttaacttatgttttcccaaagcaaacaaaaaataaactagtttggggttatgcattctcaagagatcaagcagtctgtaaaacattaccatatgattgttgtactgtattagtccattttcatgctgctgataaagacagacccaagactaggaagaaaaagagatttaatggatttacagttccagatggctggggagacctcacaatcatggaggaaggcaaggaggagcaagtcacattttacatggatgacggcaggcatgagagacagagagagagaaagagtgggtgcacgcacatgagagagaacttgtgcagggaaaaatcccatttttaaaaccatcagatcttgtgggacttactatcaggagaacagcatgggaaagacccacccacatgattcaattacctcccaccagatttgtcccacgataggtgggaattgtgggatttacaattcaagaagagatttgggaggggacacagccaaaccataggattgttaacattgtcacttttcaaacagttagaatgcttaggaatacaccctgaaagtgtaccaaattttctttaaccattatttgatttttttaacacagtgatttagagaagatgatctcaataactctttctctctctcctatatgtaatatcaattcacaagatattttaggaaacttaggcctagaggtatttttgtcatctaaataattattttactggaaatatgtaaaaatcatggctcacagagatttctagatgataaatgctacaggagtttttcaagtgtgattctttgaaatagtgaaatatggttaactgaacacgtgcaatactgttttcaacaatagtcttatgatttttttgcaatttcaatgaaaattttaacagtgatatgattaaaagtaatatgtggttgaatcgtcaatttgaaatggaaggaatgttaatatttctctttgtgtgaaaccgtcatagcccagaaaattagaccagttacaattatggctgtacataataacagggttttcacatattttgaaagatttgtcattgagttcagataaattacaatcaattcagtgaaaaaaataaattattctaatggatttgatgtgtgtttgtattcactttactgagttgatgagtcaaattgcttgtatggatagacatcactgaatcaattaatgtattttcaaaaatgaattaataaattggaaattaaactcacatttttgtatatagaagcagaggactggagagcaatattttcattttcagagcatggctttttaaatgtgtatattaaaacaaacatacattatttacaactttttctttagtctgtagagtagagagaagtaactcattacgcaagtataaaaatggggtttctcttgttgaggaagaagagaggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcaggactaaacgcaaatgttggcatgaaacctttatcatactgccagctaagaacaggagcccaacaaaaaaggaactc

SEQ ID NO: 734207 - DNA, 283 bp, Homo sapiens
tgctttttcctttcattgacttgtttatacagggatagaaactatcctattgcagttggaatcattttattaaagcaaacttttgctggtacttttctctccagcacaatgccccagcaaatgaagtccggactggatcatcgggagtcattcctcagtccagggtatccgggtaattattttaactcccagacttgctcttggagtattaaagtggaaccaaactacaacattaccatctttgtggacacatttcaaagtgaaaagcagtttgatgcactgg

SEQ ID NO: 734208 - DNA, 1087 bp, Homo sapiens
gtagggggtgagttgcaggggctgggacagagcaccagcatcctgcatcattagcagcacgtgggaaccctagtgtatgggtgcaaggccacttgcctcagttttccaggcgttcccaggggcctccatttctcatcttgaaaaaagcagcaaggctttggtaccagagggtcttggtgtaagtgcaaatctgcttcagatatatattagctgtggatttggggctggttacaaggcttatctgagcctcactcttttcttgggagataagggaaaatagtccttgcctgatgggctgcagtgaggattcaattaggcaatgtcccttagagctctggggagctgtgaaaccggtgatgccaggctgatgtctatgaaatgcactgggagtgaggaaagggtcacagatctccgcctgggtgttggaatatccagggaccgtgggaggctcccgggggccccatgctagtgttctccaccaaagacagaggagacaggtgatgtgcatgggagagctttgccttcctctctcacggaaccacaggctgtcagagccttgctccgcagcttcagtttgacaacctcagagaaccataatgatataggagttaaaaagaaattactcgggcagatagtgagggtatggaagtccttggtaagattttccttttaatgaaaagcagcccctaaatccttttctaacaaaaagcagctgtcagcagttgtgtccattggaatgtactacctaagactaagcatgttcaaaatggcggctccgtcttctctttttgcccagctatgagtgcagtaaggagaagacaagatggccaagtggaaagtccatttgcataatcagatttgggtggggtggccagcctttctcgtgcactacgtaaacgtcacacctggtcaaaccaatctgtgagccctatgtaaatcagacaccacctcctcaagcctgcctataaaatacgctgtggtccaccacttttcccttttcagatgcctctgtctcacgagagagagagctgctctcctctctcctttcttctgcctattaaacattctgttccttaacccacccaca

SEQ ID NO: 734209 - DNA, 534 bp, Homo sapiens
aaatgtctatacatgttgaatgaaagtgcaatatttcttccctgaatagttttgatctgtggttgcttgaagtcactgacctgtacactttaaaggagtgaattgtaggcatgtgaattatatctcaataaagctgttccaaaaaaactttcaaaggtgctctccctctaaagactaagtacccccagggggctccttctgttaatgcccactcacctgggtacctctggttcaggaattcatcttctaaagaccatggctcttctcctttctccaacttggagatcaccttgggtttagtaatgcaatatcctgtaaacaaaataattgacatggaccagattcacaggcttttggatttccaaagggaaaaaaagatatggcagcaaagcattaactgagggtgttcatttgaaatttttaatgggaaagtaatgacatgttgcttttgtttctgtaaaggtttcaactacttcaaaccttttaatccaaagccctttaatctctataaagggtccatgtgttttgatactt

SEQ ID NO: 734210 - DNA, 1081 bp, Homo sapiens
ggatatccaagagggagaatgaaacttcctgggcttatctggattcttctgggctatagatctcaaatagagacctgttggttgctagggtagtccagacaccccttagatgtcttcataatagtcctatctaccttcaaaaaccatctctatatatggcagactatattaacagctgctgaacaaatcagctctggaggtgattccacatcccctggcattatgctctaatgctgctcatcggagaacagacagccaggataaagtggcaccttctggagtacactggagggggcagcccaagttagaggccagcattgctgacattctggaatatttgcatctaaaaatgtttactcgttgccatgctgcagtccgcacaagctgtgaggcagaaaacttgactttgaaggcagccttgaagagtgagttcatgagctcatggtttttctccttgtatggactgctcgctccaagggcaggcagagctcatgaatgcctcttatcttcctaagcggagttttaggtgacacaggatgaagcagaagagatctacccatctcatctgctctgcacccagcttctaagtggacaaagccaagcccaggcatgagctctggcaaagcaagaccccagattctcccatttttgcctgtggaaaggagggtccctttacaggcttttttttcctttttttcccccaaaatctcttaaaatgaggaatctcttagcagactttggagttccccattctgccacattctgaccatgagacgcggcttgcagtgggggtgaacgcacataaaaagggaccactgacgtcctgctctactctctgctttctatttatttattttgggggtgggttggggagtcagaagaacctggaggacggaggaaaccaggggcaatgtttacaagactggtggacaagtgtaaatatggaataagaacaaacagttctaattaattccttcttctgcagtatggaaacctattacgatgcccttgagtcaagcactgagatacgttacccaattagggaaataaatttgttaataaaattgctgaggtcaccagt

SEQ ID NO: 734211 - DNA, 433 bp, Homo sapiens
  misc_feature (376)..(376): n is a, c, g, or t
tgagttaacggtatttcaagccaaaccccagtatatgatgcagaacaaggacccaaagtgaggctgaaaggtgaacttgcaagtacaggcttatcatttcatggaatgtgattatttagctattttaaagcagttgcttatcctactacaggttacttattgtatggcaaaaatgaaaacacagatctctgtggatccaaaaacattttggaagctatgttaagacatcatttacgttggttttcacgtaagtgctgggctttgaagcattttttatttttttaagacacaggatctcactgcgtacactggcgtaccctggtgtgattatagctcactgcaacctccaactcctgggactaagcaagtctcgccnagtcagcctgtagctgagctaccacgtctggcctgaagcatttctagttctagtttg

SEQ ID NO: 734212 - DNA, 351 bp, Homo sapiens
aatgttgctttatataataggtctgtttctcttaagtgtgcaaaataaatttttgtaaattgagctatacttaagatattgttaaagaaccatgaagtggctctttgtgtaatttgctgtgtaaaaatcttaatctgatttcttataagtttttctgcattttaactgcaacctgttcatcataatctaatagatagtggtttaagagcatagaatctgtagtcagactgcctgggttcaaatccaggctcttccatttagctaccagctttatgcttggttgtagatcctgttaaggtaggaataatagtagttactttaaaaggttattgagaaaatctagagagttaa

SEQ ID NO: 734213 - DNA, 345 bp, Homo sapiens
acgcaggatgagccggaccgaattcgacagtgtgcaaaataaatttttgtaaattgagctatacttaagatattgttaaagaaccatgaagtggctctttgtgtaatttgctgtgtaaaaatcttaatctgatttcttataagtttttctgcattttaactgcaacctgttcatcataatctaatagatagtggtttaagagcatagaatctgtagtcagactgcctgggttcaaatccaggctcttccatttagctaccagctttatgcttggttgtagatcctgttaaggtaggaataatagtagttactttaaaaggttattgagaaaatctagagagttaa

SEQ ID NO: 734214 - DNA, 416 bp, Homo sapiens
ggaacatgcacgctggtttgcagatcccttgcagtgactctacagctcccaggaatctgaggttcacaaggtgaaacctaccaggccaaacaatttaaaattggttttgttttgaaaatccagtaagtatgatggcaatgtcttgcagaaattcctcttttagtattccagtctgtgggctctggcagaagtaatagtctgctgcaaacagatcactcttttttgtttgcaaagtcttcgtaccagctgaatcacagcttgcttttcacttttcgtaacaccttgcaacatcgcaaaatatttgctggagtttgtgaagggcggctgcagaattagtaaactgaaaggaggccttcctttactcccacccctcccttccagctatgtgtacaataatgaccaatctgtttgggctt

SEQ ID NO: 734215 - DNA, 898 bp, Homo sapiens
tgagaactagaaactgtgtcaagggcgactaagccctgctgtgctgtgagaaagttaaacttatttgcaaactttatggcctattttggccttaatctccatgtccagcatctggggaacaatgttttcctgttgcagactctctttggtgcagtcatcctcctggccaactgtgttgcaccttgggcactgaaatacatgaaccgtcgagcaagccagatgcttctcatgttcctactggcaatctgccttctggccatcatatttgtgccacaagaaatgcagacgctgcgtgaggttttggcaacactgggcttaggagcgtctgctcttgccaatacccttgcttttgcccatggaaatgaaagcaaaatgataaatcacaaattgcctgtgtggatttttaacagatattcttgtattgctgtttccactcaaagggcaagagctatggggatcaatgcaacctttgctaatatagcaggagccctggctcccctcatgatgatcctaagtgtgtattctccacccctgccctggatcatctatggagtcttccccttcatctctggctttgctttcctcctccttcctgaaaccaggaacaagcctctgtttgacaccatccaggatgagaaaaatgagagaaaagaccccagagaaccaaagcaagaggatccgagagtggaagtgacgcagttttaaggaattccaggagctgactgccgatcaatgagccagatgaagggaacaatcaggactattcctagacactagcaaaatctagaaaataaataacaaggctgggtgcggtggctcacgcctgtaatcccagcaccttgggaggctgaggcgggcagatcatgaggtcagaagataaagaccaccctggccaaca

SEQ ID NO: 734216 - DNA, 849 bp, Homo sapiens
agcaaaatgataaatcacaaattgcctgtgtggatttttaacagatattcttgtattgctgtttccactcaaagggcaagagctatggggatcaatgcaacctttgctaatatagcaggagccctggctcccctcatgatgatcctaagtgtgtattctccacccctgccctggatcatctatggagtcttccccttcatctctggctttgctttcctcctccttcctgaaaccaggaacaagcctctgtttgacaccatccaggatgagaaaaatgagtgagtaaatagcccggttgcccctcagaggatctgtgtgctataggtctgtgctgaggaaggcaaaataccatttagggccactgtcctctcaaaaggcttagacttaggattttcccatgtaatcagtgccttaggtctaggtacagccacatgccttcccacagtgacctcagacaccctctggaggctctcccagatcacacagaccagctctgcccagcttgtcaaaggaggctttcatagtgaagaagccaaaattaggtctcctcttccctccctgccctagtgtgatatgcacactgttgaaggtattttacaaatatgcagagatccaaacaccagattttcatccctgggaaaccctcaaacaagtgggtacctgtaagctgtctgagattgccagtgcttacaggcctgactactaggccactgaagaatttgtggaagagtatgcagatgcaggggtatccaatcttttggcttccctggtctacagtggaataagaattgtcttgggccacacataaaatacactaacactaataatatctgatgagctaaaaaaaaa

SEQ ID NO: 734217 - DNA, 452 bp, Homo sapiens
ctaatgctatccctcccccagtgcccagccccccgacaggccccggtgtgtgatgttccccaccctgtgtccaagtgattccattgttcagttcccacatatgattgagaacatgtggtgtttggttctcgctgtcctttttataaagccccagtgtctcgattatttttgctttgcagcaagtcttaaaatcaggtacacagtgtgggtcttccagctttattcttttatagaattgtttgagtatttaaggttctttgaccttccataaaaatgttagaatcagcttgtccatatctccaaaaaactcttgccaacattttggttggaattgatattaaattttagatcagactggggagcattgactgtatatgtagcatcttagcaatataaagttgccaacacatgaacatattatgtctctccaactacttaggtctttgattaag

SEQ ID NO: 734218 - DNA, 1782 bp, Homo sapiens
attgtcatctgctgaatcaggctaagggtaggtcctggaagatactccttccaaaccttataatcagaggtgactgcacagttggcttacaagagcctcttttcaaagtaattggggatgcagtgcttagaactgggctggcattgtaatttttttaggaatctgctcccatttacaagacgttccatcataaaaatcaaatcataaaatcaaatccaagtatgttcatttggtatattcattttccacttcttactaggggtggtgggggaggagaagctggtacaggagaaatgtcttttatttcccctctataacaatggtataattccaaatcttatagaccatcacacagttctgttagttgattgttttccgtggattctaccctgccaggagacacaataaataactttttgaaacttcattcttcagtcctgggagtttttacaaataaaaggacacacatgttgagacaaattacatgcttgaaaatctgtcactaacatcaatttcatgttaaaaagtactaagcaactattacagtggcatttcttttgttgttggggaaaataatgtgaatagctatgctaattcagagataattttcaaatttcgtgactaaataaaaaagctaagagtagttcactaggtaatgtttgggagggagttgttggttttgttgatttattatatcttgactggtatgattgaaatgaattaaatgttagacgtgcttaacattttatatgctatatatcatcataatagcaaagtgcacagatcacattattgagtgcctttggattttaaaaataaagattgctattcagatgaataccatttcattattgcctgcactactctgtcaaattaaaaaatataatagctatctttattctcgttttaaagcatgataatcatcaaaatgttgaagtttatcacagttctacattaaaaataagtcatttttgtagatgagttatccaatacagcaaaggccatcaaagagaaagccaatactttcatggagagctcagagccttaatagatcccagcagcaatgcttcaaccattcccaactccatgttccttgctagatgctcctcaccccaaactcctgcaaatttcaagaatttctgtgtatgtgtgtgttaagggaggagttttaaagtatctctgtattcaacaagatacgtcagcttgtaagcagcagaaacctacttaaactagcttacatgagaaaataacattataaagacataggagtgtttctacaccaagagctggaggtattgtttggtttcatgaaggattaaaatctgtaattcaaaagtagactcaggcagctgcacatcaatctgtgtctttctctctggtactgtggactctatcctgtctgacttgctttgttcctgggcatcattcttgctctggaaaacacactttccctgctcatttttttattttaatgcttaggttcaatctgctcatttttccctacagcagaagacagcttactgtgttccagcaaacaacagagcctgaccagcctctctgaatatggggcccccttctcactcacaagtattcttaacctggggtccatgtggggtttgtgaatttggataggattttaaaattacattttcatttccactaatctctaaccgaaattcagtcttttcttcaactgtgaatgtaggcagcaagccacagtggaacttgccgaacctataaatttgtcactgtgattgatgttataatgttacacctagatct

SEQ ID NO: 734219 - DNA, 621 bp, Homo sapiens
ccaaagtgttccgggcggggaggggggcgagggaggtgagtatgaggagtggagtggagctggacccttacaaagggacagcgacaaacacctcatactcaaaacaaggggactttccgtgtcatttgcgccgtcgggccattgcaaatgtccgcgctgagatgcctaccttgtcactcgacgcagccgccaaagctcacccggagctgcgtcagtccccactgggttcctccaggccaaggaggtacgacctccgccgcagcatataaagtaaatgtccaggagatgggaagaaacccgccgatacagcacccgggtgcccaagcccccgagaactaggccgcgcgggtactacggggtgcgcgatcggccagaaagcccgggccaggacgggcccaggagcgagcaccgtcgggaacaagcgtcgggaacaagccgggattaagaggaagcgccggcgccaacggtctcccgcccgccgcggtccccccaggactcttcctgcgcttgcaagcgccacgccgcccacaggactgcgccagccggccggcgcctcaacagagcgcgccacggagcagcgcccctcgggagacatgacgcctgagccatcgaggcggccgc

SEQ ID NO: 734220 - DNA, 509 bp, Homo sapiens
cactggccttggccacccacttctcccagcctgtgtcttcctgatcctgggaaggcctggatgaccaagcttggtgaaattcctccctgtacacaccctattaactccttggctgtggtcccccagctacaccaccagcccaggtcctggctgccagctttcctcctctgcccggcctctagcgcagtcgctaactactctgctgggctccctgggtctctgcccaaggccccgcacacactggggcctagcatagttcctgcctatgccaggagctggctctgtgtttaagaaaaggaggactgaaggacaaacaaccaagagtggcccagtccccacccccacatctagctcagtctcaaatctgagtgggaccaagtgcaattcagggcctttttctccactcacctgcacccagaagcagagaaaagcaggcactgttcacttttcctttattcttaatggccttcctctgttgcaacctcaataaacagcacaatctcaaagct

SEQ ID NO: 734221 - DNA, 722 bp, Homo sapiens
tttttttggtctaatattagcaatgaaaagctcaagaagttcataaaatttgggttgtttttaataatagttatagcaatagtaaaaaatttctttttctacttactatattatgtaaggtgaaatacttgggattaaactgaaaaccctaatagattctagaatcaaacaaatgggggttcaagtcttggttctgatgcttactaaatctttgaccttgggtacattatgtaatctctctttgtttcctcatctgtaaaacagggataataataactatgtcatagggtttatgtgaggtttaaataataccctgtttataaagcccttgcttagtgcttagtagtgtttaataaatggtagtagttactttgacaaaaaagtatgagtcctaatttattgtgaaactaccaccaaaatcaattaacaatccacccaaattttgtaaaaggtgtttggaatgtctttctgtccccaaagcttgttgatcttgtacttttcaattaatttattattgtcctcttgagatttaacctgcaggccagtggtttctaaatgataaactgtggattggtgctggttagtgagaaagttttcactgggccttggtgaaatggaagagtaagcaggacaatgtaatgatatcataaagttaaccttaactcagagctcagcgcctgctctttttagcatgtgcgcacgcgtgtatgtgtgtgtgtgta

SEQ ID NO: 734222 - DNA, 614 bp, Homo sapiens; identical to SEQ ID NO: 197017

SEQ ID NO: 734223 - DNA, 2374 bp, Homo sapiens; identical to SEQ ID NO: 282292

SEQ ID NO: 734224 - DNA, 851 bp, Homo sapiens
gtgtgaagaaataagaagaatcagtgatactcctagacattggagctcagtgacaggaaacagtaatcatgttgtcgtctactgagaagggcaaggatgaaggaatgagcaggtttgggcaaagaactaagaattgagtttttgaatgtttgtttttagactctaagcagaatccaaatggagatgctcagtaaggagatggatatctaggtcgagagctcaggcaagaggctgagagtaagaacataaatccaggagtcaccagaatacgctaggtatttaaagctaagaaattagatgaggttctttttaaaatcttacttaataaaaagtacagaaatttttctaagtgctttacaaatattaactcaaccctcttaacaactctctgaggtaagaactattattactcttatattccatattaaagataaggaaactgagacacagattatctaagcaactaggcccaaaatcacactaccggtaagcagcaaacctgggactgaatccaagcagtgtggccccagtctgaattcttaacactaagctaaattgcttcctaatactctaagggaaaaaaaaaagtggaaggagagaagaggctccggaactgagccgcagggcactcaacttttagaagttgcaaaaaggggaagcaaaaaaatttaaaaggagctaagtagaaaatgagaaaaagtttggtgtcctgaaatcccatgaataaaatactgtatatcaaagaggaatgcttaagagatcaaaaaagaaatggactagaaagtgaccattggatttggcaaggtggaagtcactagagactttgaaacatacttgatgaaataagttat

SEQ ID NO: 734225 - DNA, 875 bp, Homo sapiens; identical to SEQ ID NO: 36037
  misc_feature (812)..(812): n is a, c, g, or t
  misc_feature (815)..(815): n is a, c, g, or t

SEQ ID NO: 734226 - DNA, 470 bp, Homo sapiens
gtgtgaagaaataagaagaatcagtgatactcctagacattggagctcagtgacaggaaacagtaatcatgttgtcgtctactgagaagggcaaggatgaaggaatgagcaggtttgggcaaagaactaagaattgagtttttgaatgtttgtttttagactctaagcagaatccaaatggagatgctcagtaaggagatggatatctaggtcgagagctcaggcaagaggctgagagtaagaacataaatccaggagtcaccagaatacgctagacaagaacactggaactcaaagaatttaacttgcctatgatttcaccgtgagctgagaagtggcagaggtaaggagtgaacttttttctactcttatataaacttccaagtttcagtgacatgctctaaggaagagtttaaaaagaaaaattcaacatccacctttcataattaaaatacacaaagacaagtaaa

SEQ ID NO: 734227 - DNA, 1192 bp, Homo sapiens
  misc_feature (721)..(721): n is a, c, g, or t
gctgtgggagccgtcagtggctgagctcgccaagcagccttggtctctgtctacgaagagcccgtggggcagcctcgagagccgcagccatgaacggcacagagggccccaatttttatgtgcccttctccaacgtcacaggcgtggtgcggagccccttcgagcagccgcagtactacctggcggaaccatggcagttctccatgctggcagcgtacatgttcctgctcatcgtgctgggcttccccatcaacttcctcacgctctacgtcaccgtacagcacaagaagctgcgcacacccctcaactacatcctgctcaacttggccgtggctgacctcttcatggtcttcggaggattcaccaccaccctctacacatcactccatggctacttcgtctttgggcccacaggctgtaatctcgagggcttctttgccacacttggaggtgaaatcgccctgtggtccctggtggtcctggccattgagcgctacgtggtggtctgcaagccgatgagcaacttccgcttcggggagaatcacgctatcatgggtgtggtcttcacctggatcatggcgttggcctgtgctgctcccccactcgttggctggtccaggtacatccctgagggcatgcaatgttcatgcgggattgactactacacactcaagcctgaggtcaacaacgaatcctttgtcatctacatgttcgtggtccncttcaccattcctatgatcgtcatcttcttctgctatgggccggtggtcttcacagtccaggggcggtgccagcagaggagtagccccctcagaagcggagaaggaagtccaccccgcatggttatcatcatggtcatcttcttcctgatctgtggttcctacgccagtggggcttctacattcttcaccaccaaggtcacttcggcccctcttctgactctggcagttctttgctaagagctcttccctcttttaccgctctctactattgttgaccagccgtcccgaccgttgtgcccccgtgtgcgggaatccggggagagaacccggccccgtcaaaggaacaccgggtccctatcgcgcatggtgataggtcttccccccccagcccagacggggagaaaccccttttgaataaaacccgggaagcacccacacccgggcctacgcgtagttaataaaaaagaagc

SEQ ID NO: 734228 - DNA, 1523 bp, Homo sapiens; identical to SEQ ID NO: 34952

SEQ ID NO: 734229 - DNA, 1577 bp, Homo sapiens; identical to SEQ ID NO: 34953

SEQ ID NO: 734230 - DNA, 691 bp, Homo sapiens; identical to SEQ ID NO: 34659

SEQ ID NO: 734231 - DNA, 557 bp, Homo sapiens
gccgcacatctgaatactgggtgccatgtgcccgaccctccctgcaggctgcgtcctgaggcttcccgaggcgggtctggcctccccagaaggtcggcagtcagcagagctgcgtccggatctgcttgtgctcacctgggtcatcctcctacctgttccaggccacaaataacatgaatggatgcagcggaaaatgctgtaaagggagtgggctccacgctcatcactcaccagaaaatactgcggggaggagtcccagggcttgagggagggggctccacgctcaccactgactcagaagataccgcaagggagcactctcgctgggaggagtcccaggtcttggcgacagtcctactcactgccatgacttacaacggggaggcatcagccaggggagaaggtgcggcggggccggggagaccagccgcagcgtggaaccctccccagcggagccacacgggacgctcgggctgcgagcacaggtgcgggatgctgacggggaagctgtgcgagactcagttcccagggcttttgcctaggctggcagtgcggcc

SEQ ID NO: 734232 - DNA, 906 bp, Homo sapiens
  misc_feature (6)..(6): n is a, c, g, or t
  misc_feature (223)..(223): n is a, c, g, or t
tgttgncaatatgcatttatttacttctttgacaagtttatttttgcgtatctactatgtacgatgcattgaagtccagggacaaacaaaacacagggactctgccctcctggagccgacatctggtgagggagagacgcagactctagacagatatttccaaatagcaggtaagtgctataaacaaagggaaacagggtaatgggatagagtgacagggggngggatgagttgctattttagatgaagtggtccaggagggcttccctgaggaggtggcatttggtctgagggctagagaatgagaaagcagctgtcacctgagagctggagaaagaacattccagggagagggagcatcaagacccaaagccctgaggcaaaaacaagcttgccatgttccaggaacagtgaaaggacatccattgacctaatctcaaagctgctgtcccaaagacaaagcaaaggggacccagctcccttgggtggctcctagatgctctgctgcctgaccaccagagggcagcagtgctccttctcttccaggctgagcagaaagtggatgctcatgaacgttttaggagctggggttttgtccttcagatgctcaaagcttgttcatgggcttggaggcatgtttagccctttgggatttgtaaggcagagaattccaatttcttaagcctagtaagaaatgagcaaaaacttcaatatatatgactcaggcaagaaatcagcatctgtggcaaatactagaatgaaatgcaagaaagctcactgcaaggaagtctccctccctgcagattccaaggcttggaatctttttcttctgggctccaggcagcacagacagggcctagcctgggagagggtggacaagatgtcctctcagggtcttcaatggcc

SEQ ID NO: 734233 - DNA, 10343 bp, Homo sapiens; identical to SEQ ID NO: 465004

SEQ ID NO: 734234 - DNA, 1275 bp, Homo sapiens
aacgtcccccacaagtcctcactgcccgagggatccgccctggcacggtgctgagaattcgcggcttggttcctcccaatgccagcaggttccatgtaaacctgctgtgcggggaggagcagggctccgatgccgcgctgcatttcaacccccggctggacacgtcggaggtggtcttcaacagcaaggagcaaggctcctggggccgcgaggagcgcgggccgggcgttcctttccagcgcgggcagcccttcgaggtgctcatcatcgcgtcagacgacggcttcaaggccgtggttggggacgcccagtaccaccacttccgccaccgcctgccgctggcgcgcgtgcgcctggtggaggtgggcggggacgtgcagctggactccgtgaggatcttctgagcagaagcccaggcggcccggggccttggctggcaaataaagcgttagcccgcagcgaaaaaaaaaaacaaaacaacaaaaaaagaaaaacaacaaaagaagaaacaaaaaagacaagaaacaacaaaaacaaaacataaataaaaaaaacaaacagaagggggggcggccgccataaattatcccccgaggggggccaccatattcgacggcaccgccagagtttatacaaacgagggacgcgcccacaagaaaggcacgcatataataaaacggagcagacgcggacgccagataacaacacggtagagcgggagacccacgcgcgtcacaacgagacaacagcaagagagacacgccccccacaacggggagggggcacaaacaaaaggagggagacgaaaccaacaccacaacgacgaagcaaaataaacccacccccgcagggggaagaacaacacaacaaacaacgagcggagcagaagtacagaacggtgggaacacccacaaaccacccgcgaatataatacgcagtcagagtaggagagaaaagacaccccaccgacacacgacgggagcctagtcataagacacgaaaacatctacacgcggggaggggaggtccagcttcatagcctacgaataacgccacgagcagacatcagaccagacagaaaacagccagctcacacgaagcacaaaagaaaacaacagagaaacaccaacggagcgacgaaaacgaaaagcacaaagaaaggacaaaaacgagaagagataaaaaaagagagagagaaaaaacgaaaaaacaaaaaagaacataaacaaaaaaagcaacagacaaaaaaacagaagaaccacacgcagacggacg

SEQ ID NO: 734235 - DNA, 458 bp, Homo sapiens
aacgtcccccacaagtcctcactgcccgagggatccgccctggcacggtgctgagaattcgcggcttggttcctcccaatgccagcaggttccatgtaaacctgctgtgcggggaggagcagggctccgatgccgcgctgcatttcaacccccggctggacacgtcggaggtggtcttcaacagcaaggagcaaggctcctggggccgcgaggagcgcgggccgggcgttcctttccagcgcgggcagcccttcgaggtgctcatcatcgcgtcagacgacggcttcaaggccgtggttggggacgcccagtaccaccacttccgccaccgcctgccgctggcgcgcgtgcgcctggtggaggtgggcggggacgtgcagctggactccgtgaggatcttctgagcagaagcccaggcggcccggggccttggctggcaaataaagcgttagcccgca

SEQ ID NO: 734236 - DNA, 618 bp, Homo sapiens
caggtattcatgccttctccatcatagaaaattttaacttagttttttagtgacactcatatattgtgtatttagtgacactcatatattactgtaagtattagtctctttctcactggactggaattattcaggagaagggacatggccttactcagtgtctgccacatcgtgagctcagtaaacaacaatacagggcaaagaccctgtgcttatagggtgttacagggtgttggggaatttttggttttttttttaagttttttcagcaaatcagtttattgaccagctcacaagtgttatttttttcaaaagttaacttctcttggtgttcactttaacttttggtgattcatacaagttttctaaaaagcacatgtctcttagatctttagtttcctctctatataaatgtcattccctgcccctacacaccagggacatgcacagacacatgcacacaacatatataagtcttactggatttttgtgaaattaacaatattcatgtagtgcatccaccttggtctctggcacatagtagccatctcaaatgcttgttagggagattcaggcatatacaagttaatattataaagtcaatatgtctaaaaaaaa

SEQ ID NO: 734237 - DNA, 1193 bp, Homo sapiens; identical to SEQ ID NO: 45325

SEQ ID NO: 734238 - DNA, 368 bp, Homo sapiens
gctgggtctcagggtgagagttacagaaggatatgaaataatcggggaagaggcaagttacagcgggtatcctgatgcagaccatccccagccagaaacacagccgcagaactgagcccaagctccagaccaaaaactgagcccaagctcagggtctgcatggcccagagctggcatctgtccgggggactggcccaggcaaagtgaccactgtcatccagtccaggagctgtgagctgcatggaaagaatgtgaatgaagacacaactctaaatgtggaaccatggacgctatgtgagccagtgtgctccctagccgtccagaaaaacaaggcccacttgtacattctgcaagagcataaataaagc

SEQ ID NO: 734239 - DNA, 521 bp, Homo sapiens
cttcaatccagaatgattgctaaagctattccagcacctagagtcaaataaaaatatcccgaggtgggaaggaaaacatttgtttagggaaacattaaaaacaggagagtgtgtgccttggagccagagcccagagccctgctgatgtcccggggcagaaatagcccgtttcatcatcggctctggacgaccgccgcccgcattcctcgattacagcgggtatcctgatgcagaccatccccagccagaaacacagccgcagaactgagcccaagctccagaccaaaaactgagcccaagctcagggtctgcatggcccagagctggcatctgtccgggggactggcccaggcaaagtgaccactgtcatccagtccaggagctgtgagctgcatggaaagaatgtgaatgaagacacaactctaaatgtggaaccatggacgctatgtgagccagtgtgctccctagccgtccagaaaaacaaggcccacttgtacattctgcaagagcataaataaagc

SEQ ID NO: 734240 - DNA, 639 bp, Homo sapiens
caatcccagctggcttaagaaggaaagaacacttgctggcgtctgaccaggagggcaggagtgttgccagggattcttctcatctctgggcattgcttccctgtgctgagttcatctcaggcagtcccctccaggggctgacaaggtgactcaccttggccttcatccctccagtttaacaaccccagaggacagcaggtagcttttcttcagtagttccagcaaacgtcccaaagctcacactggaccagtgagggtcacgtgcttatctctgaatcagttcctgaggctaagggcatggaatatgctgcttggccagcctggatcagatgctcagcccagggccagcgggggtagggatgtcagttcacctggacctcaggggctgacaagggggatactaaagtatgcattctcggccaggcgcggtggcacatgcctgtaatccctgcactttgggaggcccaggcaggcagatcacttgaggtcaggagtttgagaccagcctggccaacatggtgaaaccccatctctactaaaaatacaaaaattagccaggtgtggtggtgcacacttgtaatgccagctacttggaaggcttaggcaggagaattgcttgattccatctcaaaaaaaaaa

SEQ ID NO: 734241 - DNA, 925 bp, Homo sapiens; identical to SEQ ID NO: 51266

SEQ ID NO: 734242 - DNA, 806 bp, Homo sapiens
ccctattggcaggattttggagaaaaaaaaataaaagcgaatagatacctgtgaaagaaaaaataaatacattttaaaataattggaggatagaaggattacttttaaaagttctgttagtttgccagtacagagcaaaacagaaaatggacacatttttttgatcagcattctctgttctaaaaacttatttcaataagggaaagaatatgcaaagacatatatatagatatagacatacacccactccaaaagaatagtgatatctttctggtaaataatatccaaagtttggaaagaaatcaaatatccattgaaaggaaactaattttagggggataggattcacatttggaatgatctcatagttagtttactggatttctgttctggtcaacctaataattgtcttgaaagtgagatggctactgacattctagggtatggttagggagaatattctttatttttaaaaccctacaagattttttcattttttaaaataaaatgtcttatttgttaaatatgatggttatgtaggtttactcaaaagtgattttttccattgctctttattattttctgcatctctgtgttacagctgaaataatttttagtattttctttagtgcaggtctgctgaagataaattctctcagttcttgtttgtctaaaatatctttgggccaggcacgtttgttacgcctgtaatcccagcacttgggaggccgaggcaggaagatcacttggcccaagagtttgaggccagtctgggtaacatagggagacaacatctctacaaaaag

SEQ ID NO: 734243 - DNA, 459 bp, Homo sapiens
atcaggaaccagcagaaggagagcctgagctgtcacaatatctcacaatcccttgatctgatgggttggaatggctcttaaggttgtcccagtttagacagaggggatcaggtctttttacacccctcacattgatgagtccttgaatgcaagatgcagctctggatgggaaggggaataatcttgggccaggtggctcttttgggctgagggtgctgcccagatggtgactcatctggcagctgacattcaccaaaacgatcaagagctggaagagtgagtgtccagtcccaaacagggcacctagtgatgcaccagtgtaccatcacatgtgcatatataatattatttgcattcattatgaatgtctcgatttgttttgtaatagatctcccaggctcagattgagaaaaacataaaacaatttttattacaataccaaaattaactggctaatta

SEQ ID NO: 734244 - DNA, 2287 bp, Homo sapiens
  misc_feature (339)..(339): n is a, c, g, or t
aaaagcgctagggttgcaagtggcaccagagacgtgcccttgtcccggggtccatttgagggtgagcgtgttggtgccgagctgtttttttgttttgttttgttttgttttgtttttgagaccgaatctcgttctgtcgcccaggctggaatgcagtggtgtgatcttggctcactgcaacctccaccttccgggttcaagtgaatctcctgcctcagcctcctgagtagctgggattactggcacccaccaccacgaccagctaatttttgtatttttagtagagacgggttttcaccatgttggccaggatggtctcaatctcctgacctcaggcgntctgccttcctcagcttcccaaagtgctgggattacaggtgtgagccaccgcacccggccagtgctgagctgttttgacaacttggaccccgggtcctctgtgggtaggaaaatcagctccctctttgctcctctggggcagctgcacctcgggccagctttctgcctgtctgcctgccggcactgctgggtcgctgtacccaaacgcacagccggtgccccgtgctagaaggtcttcagtttccagaagaaccaaagcatctttggacctacctagggaaggacctgcctgtgacctttgccctgtcctggagggtccagctttgggctgaatggcagcacccacgctgggccgtctggtgctgacccacctgctggtggccctttttggcatgggctcctgggctgctgtgaacgggatctgggtggagctgcctgtggtggtaaaagaccttccagagggttggagcctcccctcatacctctctgtggttgtggcgctgggaaacctgggtctgctggtggtgaccctgtggaggcggctggccccgggcaagggcgagcaggtccccatccaggtggtacaggtgctgagtgtagtgggcacagccctgctggcccctctgtggcaccacgtggccccagtggcagggcagctccactctgtggccttcctaactctggccttggtgttggcaatggcctgttgtacctctaatgtcactttcctgcccttcctgagccacctgccacctcctttcttacggtctttcttcctgggtcagggtctcagtgccctactcccctgtgtgctggccctagtgcaaggtgtgggccgcctcgagtgcccaccagcgcccaccaatggcacctctgggcctcccctcgacttccctgagcgttttcctgccagcaccttcttctgggcactgactgcccttctggtcacttcagctgccgccttccggggtctcctgttgctgttgccatcactaccctctgtaaccacagggggctcagggcctgaacttcaactgggatccccaggagcagaggaggaagagaaggaggaagaagaggctttgccattgcaggagccaccgagccaggcagcaggcaccatccctggcccagaccctgaggcccatcagctgttctcagcccatggtgccttcctgctgggcctgatggccttcaccagtgccgtgaccaatggcgtgctgccttctgtgcagagcttttcctgtttgccctatgggcgcctggcctaccacctggctgtggtgctgggcagtgccgccaacccccttgcctgcttcctggccatgggcgtgctgtgcaggtccctggcagggctggttggtctttctctgctgggcatgctctttggggcctacctgatggcactggcaatcctgagcccctgcccacccctggtgggcaccactgcaggggtggtccttgtggtgctgtcgtgggtgctgtgtctgtgtgtgttctcatatgtgaaggtggctgcaagctccctgctgcatggtgggggtcggccggcattgctggcagctggtgtggccatccaagtgggctccctgcttggtgccggtgccatgttccctcccaccagcatctaccacgtgtttcaaagcagaaaggactgtgtagacccctgtggcccctgagcctgggcaggtggggacccaactccaccccacctgtcttcatcgtgaggctgccacagtgcctgactacttgtggcccaggcaggcttcccccaacacaggaacgctcatggacacctgcacactccacagaagacgttggcatgtgaggccagggtgggcaccaaagaccaggcccagagccaggggacaggttggggctgtgggcttggacccagggcctgagacctttgtgggatttgtgcaataaagtgtttttatttaaaacc

SEQ ID NO: 734245 - DNA, 2490 bp, Homo sapiens; identical to SEQ ID NO: 288779
  misc_feature (339)..(339): n is a, c, g, or t

SEQ ID NO: 734246 - DNA, 2372 bp, Homo sapiens; identical to SEQ ID NO: 288780
  misc_feature (339)..(339): n is a, c, g, or t

SEQ ID NO: 734247 - DNA, 2406 bp, Homo sapiens; identical to SEQ ID NO: 288781
  misc_feature (339)..(339): n is a, c, g, or t

SEQ ID NO: 734248 - DNA, 2321 bp, Homo sapiens
  misc_feature (339)..(339): n is a, c, g, or t
aaaagcgctagggttgcaagtggcaccagagacgtgcccttgtcccggggtccatttgagggtgagcgtgttggtgccgagctgtttttttgttttgttttgttttgttttgtttttgagaccgaatctcgttctgtcgcccaggctggaatgcagtggtgtgatcttggctcactgcaacctccaccttccgggttcaagtgaatctcctgcctcagcctcctgagtagctgggattactggcacccaccaccacgaccagctaatttttgtatttttagtagagacgggttttcaccatgttggccaggatggtctcaatctcctgacctcaggcgntctgccttcctcagcttcccaaagtgctgggattacaggtgtgagccaccgcacccggccagtgctgagctgttttgacaacttggaccccgggtcctctgtgggtaggaaaatcagctccctctttgctcctctggggcagctgcacctcgggccagctttctgcctgtctgcctgccggcactgctgggtcgctgtacccaaacgcacagccggtgccccgtgcctattacctgccagcctgtctgtttccctccagctagaaggtcttcagtttccagaagaaccaaagcatctttggacctacctagggaaggacctgcctgtgacctttgccctgtcctggagggtccagctttgggctgaatggcagcacccacgctgggccgtctggtgctgacccacctgctggtggccctttttggcatgggctcctgggctgctgtgaacgggatctgggtggagctgcctgtggtggtaaaagaccttccagagggttggagcctcccctcatacctctctgtggttgtggcgctgggaaacctgggtctgctggtggtgaccctgtggaggcggctggccccgggcaagggcgagcaggtccccatccaggtggtacaggtgctgagtgtagtgggcacagccctgctggcccctctgtggcaccacgtggccccagtggcagggcagctccactctgtggccttcctaactctggccttggtgttggcaatggcctgttgtacctctaatgtcactttcctgcccttcctgagccacctgccacctcctttcttacggtctttcttcctgggtcagggtctcagtgccctactcccctgtgtgctggccctagtgcaaggtgtgggccgcctcgagtgcccaccagcgcccaccaatggcacctctgggcctcccctcgacttccctgagcgttttcctgccagcaccttcttctgggcactgactgcccttctggtcacttcagctgccgccttccggggtctcctgttgctgttgccatcactaccctctgtaaccacagggggctcagggcctgaacttcaactgggatccccaggagcagaggaggaagagaaggaggaagaagaggctttgccattgcaggagccaccgagccaggcagcaggcaccatccctggcccagaccctgaggcccatcagctgttctcagcccatggtgccttcctgctgggcctgatggccttcaccagtgccgtgaccaatggcgtgctgccttctgtgcagagcttttcctgtttgccctatgggcgcctggcctaccacctggctgtggtgctgggcagtgccgccaacccccttgcctgcttcctggccatgggcgtgctgtgcaggtccctggcagggctggttggtctttctctgctgggcatgctctttggggcctacctgatggcactggcaatcctgagcccctgcccacccctggtgggcaccactgcaggggtggtccttgtggtgctgtcgtgggtgctgtgtctgtgtgtgttctcatatgtgaaggtggctgcaagctccctgctgcatggtgggggtcggccggcattgctggcagctggtgtggccatccaagtgggctccctgcttggtgccggtgccatgttccctcccaccagcatctaccacgtgtttcaaagcagaaaggactgtgtagacccctgtggcccctgagcctgggcaggtggggacccaactccaccccacctgtcttcatcgtgaggctgccacagtgcctgactacttgtggcccaggcaggcttcccccaacacaggaacgctcatggacacctgcacactccacagaagacgttggcatgtgaggccagggtgggcaccaaagaccaggcccagagccaggggacaggttggggctgtgggcttggacccagggcctgagacctttgtgggatttgtgcaataaagtgtttttatttaaaacc

SEQ ID NO: 734249 - DNA, 590 bp, Homo sapiens
ttgcgagaattgcttgaacccgggagcggaggttgtggtgagccgagatcgccattgcactccagcttgggtgacaagagcgaaattccatctcaaaaaaaaaaaaaaaaaaaaaatctgaaatatggaccctggaagagccataaataataaaaatatttcctacaaaatactgtgatgtttacatagaaatcattgtgttgtctgcacagcctgttccaaatagtcacaagctcgtctagtaatgaaattctataaattttagttattgagacaagttagaatgaaagagctgaatgaaagttctcttggccaggtgtgatggctcacgcctataatcccagccctttgggaggccaagacaggtggatcagtcgagtccaggagattgagaccagcctgggcaatgtagtgaaaccctgtctacaaaaaatacaaaaattagctgggcgtgctggcgtgtgcctgtagttccagctactcgggaaactgaggtggaaggatcacctgagccctggaggttgaggctgcagtgagccatgatcatgctactggactctggcctgggtaatagagtgagatcatgtctc

SEQ ID NO: 734250 - DNA, 753 bp, Homo sapiens
atagctatgccgaatcgacggtttctcgtcaagaatgagacggaatgtgggagagggatattaaaagccctaatcccctcttctgatgttcgaagaaaggcaagaccagattcttgggagatccagagattaggggcatctgcgttctatgcagcacagttacccagccctttgatgggctcttcatcgttttgtgactagctcttagaggggaagaaccttgccttagctgctaacagtggttgattcttgaaagcttatgtaatcctagagacatatccaggcatattgggattgccaataaagatgtcacttgtttccacgttggggttctccttattgactcatgagcaccacaatagagtctatacacagacttagtttggggttcttggttgggatttcagcattagaaatagatgcagcactcatggaaaaacatcatgagtgcatctgagccaattttagatgatttcattaattctgcataccttctctttgacccattgatgcaggcccacatctatccagccccaactgtcttatttgcctttaacccattctggaattacccagtatgacttatattatttctatgcacatgagaatccaaggttttagaaacctggcatgcttataactactgctgacagtccctcatagtcagggcttaaagcgccaaaatacacggaaacataagagaaaaagtcccccagtgagaaacctgattgatggaaggggaagaatgtgtgg

SEQ ID NO: 734251 - DNA, 6085 bp, Homo sapiens
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734252 - DNA, 2022 bp, Homo sapiens; identical to SEQ ID NO: 362119

SEQ ID NO: 734253 - DNA, 375 bp, Homo sapiens
ttcaacagctttgagcagctctgcatcaacttcaccaacgagaagctgcagcagttcttcaaccaccacatgtttgtgctggagcaggaggagtacaagaaggagggcgaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734254 - DNA, 4079 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734255 - DNA, 2765 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734256 - DNA, 4020 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggaaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734257 - DNA, 3876 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734258 - DNA, 5131 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggaaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734259 - DNA, 491 bp, Homo sapiens
ttcaacagctttgagcagctctgcatcaacttcaccaacgagaagctgcagcagttcttcaaccaccacatgtttgtgctggagcaggaggagtacaagaaggagggcgaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggtgggtccctcttttgggctttgctagtcacccccacagcaggcatacccagacagagcaccctcaaacccgggatgcttccttttcatttattccacacacttgagccacatggccccagaggccaaggtaatgcagttctctgtgatttcaaggattcttccagctctaactttttttttttttttttttgagacggtgtctcactctagcctgggtgacagagcaagactccatctcaaaaaaa

SEQ ID NO: 734260 - DNA, 451 bp, Homo sapiens
ttcaacagctttgagcagctctgcatcaacttcaccaacgagaagctgcagcagttcttcaaccaccacatgtttgtgctggagcaggaggagtacaagaaggagggcgaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734261 - DNA, 2841 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734262 - DNA, 2094 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggagtcggatctgacccagctccagtcggaagtggaggaggcagtgcaggagtgcagaaacg

SEQ ID NO: 734263 - DNA, 4155 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734264 - DNA, 3408 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggagtcggatctgacccagctccagtcggaagtggaggaggcagtgcaggagtgcagaaacg

SEQ ID NO: 734265 - DNA, 3942 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734266 - DNA, 4018 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734267 - DNA, 3271 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggagtcggatctgacccagctccagtcggaagtggaggaggcagtgcaggagtgcagaaacg

SEQ ID NO: 734268 - DNA, 3936 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatgggccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734269 - DNA, 4012 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatgggccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734270 - DNA, 3265 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatgggccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggagtcggatctgacccagctccagtcggaagtggaggaggcagtgcaggagtgcagaaacg

SEQ ID NO: 734271 - DNA, 4096 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggaaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734272 - DNA, 3349 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggaaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggagtcggatctgacccagctccagtcggaagtggaggaggcagtgcaggagtgcagaaacg

SEQ ID NO: 734273 - DNA, 1883 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734274 - DNA, 1966 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734275 - DNA, 2042 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734276 - DNA, 1781 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734277 - DNA, 720 bp, Homo sapiens
ggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734278 - DNA, 796 bp, Homo sapiens
ggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734279 - DNA, 3952 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734280 - DNA, 3205 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggagtcggatctgacccagctccagtcggaagtggaggaggcagtgcaggagtgcagaaacg

SEQ ID NO: 734281 - DNA, 5266 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734282 - DNA, 4519 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggagtcggatctgacccagctccagtcggaagtggaggaggcagtgcaggagtgcagaaacg

SEQ ID NO: 734283 - DNA, 5053 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734284 - DNA, 5129 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734285 - DNA, 4382 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggagtcggatctgacccagctccagtcggaagtggaggaggcagtgcaggagtgcagaaacg

SEQ ID NO: 734286 - DNA, 5047 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatgggccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734287 - DNA, 5123 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatgggccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734288 - DNA, 4376 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatgggccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggagtcggatctgacccagctccagtcggaagtggaggaggcagtgcaggagtgcagaaacg

SEQ ID NO: 734289 - DNA, 5207 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggaaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734290 - DNA, 4460 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggaaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggagtcggatctgacccagctccagtcggaagtggaggaggcagtgcaggagtgcagaaacg

SEQ ID NO: 734291 - DNA, 2994 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734292 - DNA, 3077 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734293 - DNA, 3153 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734294 - DNA, 2892 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734295 - DNA, 2912 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734296 - DNA, 2988 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734297 - DNA, 2241 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggagtcggatctgacccagctccagtcggaagtggaggaggcagtgcaggagtgcagaaacg

SEQ ID NO: 734298 - DNA, 2405 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734299 - DNA, 2481 bp, Homo sapiens
acctccccacactgatgcttcttttgttgactctccttcctgcagctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734300 - DNA, 4023 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734301 - DNA, 4099 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734302 - DNA, 3352 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggagtcggatctgacccagctccagtcggaagtggaggaggcagtgcaggagtgcagaaacg

SEQ ID NO: 734303 - DNA, 3516 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734304 - DNA, 3592 bp, Homo sapiens
gggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagagatgcggtttcaccatgttggccaggctggtcttgaactcctgaccttgtgatccactcgcctcagcctcccaaaggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 734305 - DNA, 3608 bp, Homo sapiens; identical to SEQ ID NO: 447246

SEQ ID NO: 734306 - DNA, 3735 bp, Homo sapiens
gagaagactggagaaagaatagagggctgagaccagaggtgaagcgggagggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcacgcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggtgagggagctcggcaaggcagccgaggggggcggggggcagcagggtctcaggcagctggtcccaggctcccctcgccctgctggatggctctgccacctggttcccactcttctctctcttcccatctctccgggcacccactctgtcttctcacgggtctctgtctgtgtggtttccttgtctctctccctctctgtccctctctctgctgggcggctcgccttgcctgtctctctccatctcttactctgtctctttctttccttctttgtctctccaggttgggtggagaaggaaacctactactgacctcagccccaccacatcgcccatctcttccccgtcccgcaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaagcggtgtgtg

SEQ ID NO: 734307 - DNA, 3452 bp, Homo sapiens; identical to SEQ ID NO: 447247

SEQ ID NO: 734308 - DNA, 3891 bp, Homo sapiens; identical to SEQ ID NO: 447251

SEQ ID NO: 734309 - DNA, 2857 bp, Homo sapiens
gagaagactggagaaagaatagagggctgagaccagaggtgaagcgggagggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcacgcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccgcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaagcggtgtgtg

SEQ ID NO: 734310 - DNA, 3013 bp, Homo sapiens; identical to SEQ ID NO: 447249

SEQ ID NO: 734311 - DNA, 441 bp, Homo sapiens
gaacaaagaacagagaagctgaacatactgacatatttgttctccgttttaaagtttaacttcctcgttcgttatgcctccttgcccctagtttcattaaacaacccccttctagcctctaacacctgctttgtctttagtcattcttagtaacctgctctgtccttagtcatccttagacacctgctctgtaactgtctttcccgctgaaactactcaccctgccactccagctcatacccctgccctctttaaatagccaatctgaattggcttagagtgtgcagtccaaccctatccaatagggaaaagacacaacagtagggactagctgcgttagaaataagaacactttcccctcccttgtccggtgtgatcttgccattgctccatctgcaagaccactcttccatagaagtaaatttgccttgctgtaaaaac

SEQ ID NO: 734312 - DNA, 731 bp, Homo sapiens
gcaagctgaatgagtagaagttttccaggtaaagagtcagaaggatgatatttagcagaaggaaaatttaaccagactgtgtgtttggcagaaggaacatctgaaggaacacctgacgaggctgcacccttggcggaaagaacacctgacacggctgaaagcttggtggaaagaacacctgacgaataggatacagtgaattcctcttcaaagattttagcctgtaaacatcctttaaaattcaagaggggggaagattaagtacaatgagttctgagttcctcatcaaagaacaaatatgtcagtatgttcagcttctccgttctttgttctccgttttaaagtttaacttcctcgttcgttatgcctccttgcccctagtttcattaaacaacccccttctagcctctaacacctgctttgtctttagtcattcttagtaacctgctctgtccttagtcatccttagacacctgctctgtaactgtctttcccgctgaaactactcaccctgccactccagctcatacccctgccctctttaaatagccaatctgaattggcttagagtgtgcagtccaaccctatccaatagggaaaagacacaacagtagggactagctgcgttagaaataagaacactttcccctcccttgtccggtgtgatcttgccattgctccatctgcaagaccactcttccatagaagtaaatttgccttgctgtaaaaac

SEQ ID NO: 734313 - DNA, 778 bp, Homo sapiens
tgtaataaatttggtaaatttttttatatcagtgttaaaatagtgattttatttatttcatttttatacatagcattcatcaacaacttttggaatataaacaaaagatatctaaaaattctcaaaatagtaatccagaaggaacatctgaaggaacacctgacgaggctgcacccttggcggaaagaacacctgacacggctgaaagcttggtggaaagaacacctgacgaataggatacagtgaattcctcttcaaagattttagcctgtaaacatcctttaaaattcaagaggggggaagattaagtacaatgagttctgagttcctcatcaaagaacaaatatgtcagtatgttcagcttctccgttctttgttctccgttttaaagtttaacttcctcgttcgttatgcctccttgcccctagtttcattaaacaacccccttctagcctctaacacctgctttgtctttagtcattcttagtaacctgctctgtccttagtcatccttagacacctgctctgtaactgtctttcccgctgaaactactcaccctgccactccagctcatacccctgccctctttaaatagccaatctgaattggcttagagtgtgcagtccaaccctatccaatagggaaaagacacaacagtagggactagctgcgttagaaataagaacactttcccctcccttgtccggtgtgatcttgccattgctccatctgcaagaccactcttccatagaagtaaatttgccttgctgtaaaaac

SEQ ID NO: 734314 - DNA, 1575 bp, Homo sapiens
agcgggcgtaacggttctgctcagctgcctaaaggttctgctcaggtgcctaacggttctgctcagctgcctaacggttttgcgcagccattttctcccgggagaggttggagtgtccaaaagcttggcccgactgagatttctagtcttgtcagggcggatgcagggactgaagaagggcgagggcgagcggcggggactggggaagggcgagcagcgggaggcacgggctctctctagcaggtggctgcagccatggagaggctctctgccgcccctgtcaagggccagacgggcccagagcgcccgagccccttcagtcagctggtctacaccaacaacgactcttacgtgattcaccatggggatctcaggaagatccacaaagctgcctcccggggccaagcctggaagctggagaggatgatgaagaagacgacaatggacctgaacataagagatgcgaagaagaggactgctctatactgggcctgtgccaatggccatgcagaagtagtaacacttctggtagatagaaagtgtcagcttgacgtccttgatggtgaaaacaggaccattctgatgaaggctctgcaatgccagagggaggcttgtgcaaatattctcatagattctggtgctgatccaaatattgtagatgtgtatggcaacacagctgtccattatgctgttaacagtgagaatttgtcagtggtggcaaaattgctgtcctgtggtacagacattaaagtgaagaacaaggctggccacacaccacttttattggccataaggaaaagaagtgagcaaattgtggaatttttactgacaaaaaaatgcaaatgcaaatggagttgataagtttaaatgcattcatcaacaacttttggaatataaacaaaagatatctaaaaattctcaaaatagtaatccagaaggaacatctgaaggaacacctgacgaggctgcacccttggcggaaagaacacctgacacggctgaaagcttggtggaaagaacacctgacgaataggatacagtgaattcctcttcaaagattttagcctgtaaacatcctttaaaattcaagaggggggaagattaagtacaatgagttctgagttcctcatcaaagaacaaatatgtcagtatgttcagcttctccgttctttgttctccgttttaaagtttaacttcctcgttcgttatgcctccttgcccctagtttcattaaacaacccccttctagcctctaacacctgctttgtctttagtcattcttagtaacctgctctgtccttagtcatccttagacacctgctctgtaactgtctttcccgctgaaactactcaccctgccactccagctcatacccctgccctctttaaatagccaatctgaattggcttagagtgtgcagtccaaccctatccaatagggaaaagacacaacagtagggactagctgcgttagaaataagaacactttcccctcccttgtccggtgtgatcttgccattgctccatctgcaagaccactcttccatagaagtaaatttgccttgctgtaaaaac

SEQ ID NO: 734315 - DNA, 814 bp, Homo sapiens
ggttctgctcaggtgcctaacggttctgctcagctgcctaacggttttgcgcagccattttctcccgggagaggttggagtgtccaaaagcttggcccgactgagatttctagtcttgtcagggcggatgcagggactgaagaagggcgagggcgagcggcggggactggggaagggcgagcagcgggaggcacgggctctctctagcaggtggctgcagccatggagaggctctctgccgcccctgtcaagggccagacgggcccagagcgcccgagccccttcagtcagctggtctacaccaacaacgactcttacgtgattcaccatggggatctcaggaagatccacaaagctgcctcccggggccaagcctggaagctggagaggatgatgaagaagacgacaatggacctgaacataagagatgcgaagaagaggctctgcaatgccagagggaggcttgtgcaaatattctcatagattctggtgctgatccaaatattgtagatgtgtatggcaacacagctgtccattatgctgttaacagtgagaatttgtcagtggtggcaaaattgctgtcctgtggtacagacattaaagtgaagaacaaggctggccacacaccacttttattggccataaggaaaagaagtgagcaaattgtggaatttttactgacaaaaaaatgcaaatgcaaatggagttgataagtttaaatgcacagccctcatgcttgccatatgtcatggatcatcagagatagttggcacggttcttcagcaaaatgttgacatctgtgctgaagctacat

SEQ ID NO: 734316 - DNA, 751 bp, Homo sapiens
tgttgcttgtggatttaatctctaagtgtttacatttaaaggctagcattcatcaacaacttttggaatataaacaaaagatatctaaaaattctcaaaatagtaatccagaaggaacatctgaaggaacacctgacgaggctgcacccttggcggaaagaacacctgacacggctgaaagcttggtggaaagaacacctgacgaataggatacagtgaattcctcttcaaagattttagcctgtaaacatcctttaaaattcaagaggggggaagattaagtacaatgagttctgagttcctcatcaaagaacaaatatgtcagtatgttcagcttctccgttctttgttctccgttttaaagtttaacttcctcgttcgttatgcctccttgcccctagtttcattaaacaacccccttctagcctctaacacctgctttgtctttagtcattcttagtaacctgctctgtccttagtcatccttagacacctgctctgtaactgtctttcccgctgaaactactcaccctgccactccagctcatacccctgccctctttaaatagccaatctgaattggcttagagtgtgcagtccaaccctatccaatagggaaaagacacaacagtagggactagctgcgttagaaataagaacactttcccctcccttgtccggtgtgatcttgccattgctccatctgcaagaccactcttccatagaagtaaatttgccttgctgtaaaaac

SEQ ID NO: 734317 - DNA, 326 bp, Homo sapiens
  misc_feature (303)..(303): n is a, c, g, or t
agctcggtacccactagtccacggttggctactagtccacggttggctactagtccacggttggctactagtccacggttggctccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaattccattccagcgtactaccanacccttagccaaccgtgactagt

SEQ ID NO: 734318 - DNA, 801 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734319 - DNA, 1880 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734320 - DNA, 2007 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734321 - DNA, 1823 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734322 - DNA, 1696 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734323 - DNA, 1518 bp, Homo sapiens
tcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734324 - DNA, 1334 bp, Homo sapiens
tcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734325 - DNA, 2160 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734326 - DNA, 2287 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734327 - DNA, 2103 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734328 - DNA, 1976 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734329 - DNA, 2113 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734330 - DNA, 2240 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734331 - DNA, 2056 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734332 - DNA, 1929 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734333 - DNA, 768 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaaatccaagtcttccagtaaatctagttcttccagaaaaatctagatcttccagtcaatcagtgtcttccagaaagaaatccaggtcttccagtcaatcagtgtcttccagaaagaaatccaggtc

SEQ ID NO: 734334 - DNA, 2287 bp, Homo sapiens; identical to SEQ ID NO: 734326

SEQ ID NO: 734335 - DNA, 2103 bp, Homo sapiens; identical to SEQ ID NO: 734327

SEQ ID NO: 734336 - DNA, 1833 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734337 - DNA, 1960 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734338 - DNA, 1776 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734339 - DNA, 1649 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734340 - DNA, 488 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaaatccaagtcttccagtaaatctagttcttccagaaaaatctagatcttccagtcaatcagtgtcttccagaaagaaatccaggtcttccagtcaatcagtgtcttccagaaagaaatccaggtc

SEQ ID NO: 734341 - DNA, 2007 bp, Homo sapiens; identical to SEQ ID NO: 734320

SEQ ID NO: 734342 - DNA, 1823 bp, Homo sapiens; identical to SEQ ID NO: 734321

SEQ ID NO: 734343 - DNA, 1173 bp, Homo sapiens
  misc_feature (31)..(31): n is a, c, g, or t
actagtccacggttggctagtccgggtcttncaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734344 - DNA, 989 bp, Homo sapiens
  misc_feature (31)..(31): n is a, c, g, or t
actagtccacggttggctagtccgggtcttncaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734345 - DNA, 1511 bp, Homo sapiens
  misc_feature (39)..(39): n is a, c, g, or t
gacgaatcatagcttccagaaaaatctagatcttccagncaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734346 - DNA, 1638 bp, Homo sapiens
  misc_feature (39)..(39): n is a, c, g, or t
gacgaatcatagcttccagaaaaatctagatcttccagncaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734347 - DNA, 1454 bp, Homo sapiens
  misc_feature (39)..(39): n is a, c, g, or t
gacgaatcatagcttccagaaaaatctagatcttccagncaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734348 - DNA, 1327 bp, Homo sapiens
  misc_feature (39)..(39): n is a, c, g, or t
gacgaatcatagcttccagaaaaatctagatcttccagncaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734349 - DNA, 466 bp, Homo sapiens
  misc_feature (39)..(39): n is a, c, g, or t
gacgaatcatagcttccagaaaaatctagatcttccagncaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccagtcttccagacatcgattgcggttactaggtactctagtacagctagcg

SEQ ID NO: 734350 - DNA, 1115 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccagtcttccagacatcgattgcggttactaggtactctagtacagctagcg

SEQ ID NO: 734351 - DNA, 1068 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccagtcttccagacatcgattgcggttactaggtactctagtacagctagcg

SEQ ID NO: 734352 - DNA, 865 bp, Homo sapiens
  misc_feature (713)..(713): n is a, c, g, or t
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtctgacattcaggtcttccagtgtcngcaatatccagggtttccgatggcacctgtgtcaaggtcttccaacaactccgggtcttccagcgacttcaagtcttccaataatctcaaggtcttccagataatcctgagcttccagaaaatccacatcttccagacaaggtagagccgag

SEQ ID NO: 734353 - DNA, 835 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccagtcttccagacatcgattgcggttactaggtactctagtacagctagcg

SEQ ID NO: 734354 - DNA, 788 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccagtcttccagacatcgattgcggttactaggtactctagtacagctagcg

SEQ ID NO: 734355 - DNA, 585 bp, Homo sapiens
  misc_feature (433)..(433): n is a, c, g, or t
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtctgacattcaggtcttccagtgtcngcaatatccagggtttccgatggcacctgtgtcaaggtcttccaacaactccgggtcttccagcgacttcaagtcttccaataatctcaaggtcttccagataatcctgagcttccagaaaatccacatcttccagacaaggtagagccgag

SEQ ID NO: 734356 - DNA, 564 bp, Homo sapiens
  misc_feature (313)..(315): n is a, c, g, or t
  misc_feature (318)..(318): n is a, c, g, or t
  misc_feature (321)..(321): n is a, c, g, or t
  misc_feature (336)..(336): n is a, c, g, or t
  misc_feature (338)..(338): n is a, c, g, or t
  misc_feature (352)..(352): n is a, c, g, or t
  misc_feature (358)..(358): n is a, c, g, or t
acagaggatccccggcatactggaccttttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagaaagctnnntantcnggaagacatggcttngntggaagacgtgganttgctngaagacacggatttcctggaatccccggtcttccaggaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734357 - DNA, 1985 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734358 - DNA, 1801 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734359 - DNA, 960 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccagtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagt

SEQ ID NO: 734360 - DNA, 1243 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734361 - DNA, 1705 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734362 - DNA, 1521 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734363 - DNA, 680 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccagtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagt

SEQ ID NO: 734364 - DNA, 963 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734365 - DNA, 1735 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734366 - DNA, 1862 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734367 - DNA, 1373 bp, Homo sapiens
tcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734368 - DNA, 2015 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734369 - DNA, 2142 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734370 - DNA, 1968 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734371 - DNA, 2095 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734372 - DNA, 2142 bp, Homo sapiens; identical to SEQ ID NO: 734369

SEQ ID NO: 734373 - DNA, 1688 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734374 - DNA, 1815 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734375 - DNA, 1862 bp, Homo sapiens; identical to SEQ ID NO: 734366

SEQ ID NO: 734376 - DNA, 1028 bp, Homo sapiens
  misc_feature (31)..(31): n is a, c, g, or t
actagtccacggttggctagtccgggtcttncaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734377 - DNA, 1366 bp, Homo sapiens
  misc_feature (39)..(39): n is a, c, g, or t
gacgaatcatagcttccagaaaaatctagatcttccagncaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734378 - DNA, 1493 bp, Homo sapiens
  misc_feature (39)..(39): n is a, c, g, or t
gacgaatcatagcttccagaaaaatctagatcttccagncaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734379 - DNA, 473 bp, Homo sapiens
tcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccagtcttccagacatcgattgcggttactaggtactctagtacagctagcg

SEQ ID NO: 734380 - DNA, 1840 bp, Homo sapiens
tccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734381 - DNA, 1560 bp, Homo sapiens
acagaggatccccggcatactggaccttctccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaacactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagacagttgcatccagagacacttgcatccagagg

SEQ ID NO: 734382 - DNA, 416 bp, Homo sapiens
ctccaatatcctgtgcttacaatgtttccaatgtccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttcca

SEQ ID NO: 734383 - DNA, 484 bp, Homo sapiens
  misc_feature (31)..(31): n is a, c, g, or t
  misc_feature (221)..(221): n is a, c, g, or t
  misc_feature (291)..(291): n is a, c, g, or t
  misc_feature (301)..(301): n is a, c, g, or t
  misc_feature (306)..(306): n is a, c, g, or t
  misc_feature (308)..(308): n is a, c, g, or t
  misc_feature (437)..(437): n is a, c, g, or t
ggaggaatgccaatggggaccctgtctgcantgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctcnctgagccacatctcgcccttcagccacatgtcctccctgagccacatctcgcccttcagccactccagcnacatgctgcnacgcncncgccgatgcacccgccatccagcctgtcctttggaccacaccacccctccagcatggtcaccgccatgggttagagccctgctcgatgctcacagggcccccagcgagagtccctgcagtcctttcganttgcatttttgcaggagcagtattcatggaaggcttaaacgcgatgg

SEQ ID NO: 734384 - DNA, 1813 bp, Homo sapiens
tggccgaggctcaagagagcgtggcgtcgcattgccgtttttgctcagaatcgcgactaaggctttttttttttctccctctgaacggttaggctatggctgcgataaaggccgtcaactccaaggctgaggtggcgcgggcccaggcagctttggctgtcaatatatgcgccgcccgagggctgcaggatgtgctgcggaccaacttgggtcctaaaggcaccatgaaaatgcttgtttctggtgcaggtgacatcaaactcaccaaagatggcaatgtgctgctcgatgagatgcaaattcaacatccaacagcttccttgatagcaaaagtagcaacagctcaggatgacgtcacaggagatggtactacttcaaatgttctaattattggagagttattaaaacaagctgacctgtacatttctgagggcctgcaccctagaataatagctgaaggatttgaagctgcaaagataaaagcacttgaagttttggaggaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaagttgatccaaggattagttttggatcatggtgcccgtcatccagatatgaagaagcgagtagaagatgcatttatccttatttgcaacgtttcactggaatatgaaaaaacagaggtgaactctgctttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaagactctctcttgcttgtggtggaatggccgtgaattcttttgaagatctcactgtagattgcttgggacatgctggtcttgtgtatgagtatacattaggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcttgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtcttttgggtc

SEQ ID NO: 734385 - DNA, 672 bp, Homo sapiens
ggacgcaggcgggaagtgatcaaggctccctgagtcccacccgagcgctcccggttcagcgcaggaggacgcacgccgggccaggggcctgcaccctagaataatagctgaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaagttgatccaaggattagttttggatcatggtgcccgtcatccagatatgaagaagcgagtagaagatgcatttatccttatttgcaacgtttcactggaatatgaaaaaacagaggtgaactctgctttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaag

SEQ ID NO: 734386 - DNA, 816 bp, Homo sapiens
actctctcttgcttgtggtggaatggccgtgaattcttttgaagatctcactgtagattgcttgggacatgctggtcttgtgtatgagtatacattaggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcttgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtcttttgggtcttaatagtctcaaaaatatttcatcaaggtataaagaacacaataaatacttttacagtaaaggaa

SEQ ID NO: 734387 - DNA, 498 bp, Homo sapiens
ccatctgccaccctacactctcaatccctaagtaaaacggattctctggggagacgcagcacatcgcctggctctgcagcccccaccacattgtagcgtacacccgtggaggagtttggggtcacacacttaccggcatggtggctgcctggctgagcccggggacagcatgtactcatccgaagaggggacccatgaccgtggtgtgcacagtacaagagctcgcttgggatctctgataaaggaagtccaccatgcagggttgagctgaaccacagaagcccagcctgggagcagggctccaggactccccaaggatcagaaacctcaatgataaatttccgactggatgatacacactacacctgttcttcagcgatgatgtatggtgtgtctaacatctgcctattagcagctgaattcccttctatgacgtgatacataatgtatggtgtgacacagctgggtaataaacaatgtcagctgcgtcctaaaaaa

SEQ ID NO: 734388 - DNA, 484 bp, Homo sapiens; identical to SEQ ID NO: 48193

SEQ ID NO: 734389 - DNA, 729 bp, Homo sapiens
agagaacttctccaccgaccccgtcacctggattggatcaccgacctctcccaagaggggcctggcttcctcctcgctggggaaacggtagggagctcccctaggtaaagcctctagggagagtggccaggagccgggtcaggaaaggctctggtgcccaaagggctgcccgcagaggctgaggtccctgcaagtgcacagggaggagaggtgagatcagattccagccgagtcaggcttccatgtcagactgcgtgtgtttatgcagaggtgcaactcaggaattactgaggagaaagtacagggccaatttaacctcctctgagagacctctaaccctgctcatcaccactcctcgctaaaaagggccctctccagggaagaacccagagggagagcgggaattctcctccccttggaggaagagtgcttcctctacccttaatgtatcaactgacaacaattcaaacagaaggaaactaggatgtgacaaataaaggaagccttttcatgctctatgtccactggcgtcgggcaagccccggtggaagtccaaggaaaagagtctaagacccaaacagatggtttgcgccaaagttctgaagtgtatcagacgtgaataaaggtatgttaattctaaaaggaactaaaatagaaacatgatgtggtttagactcaggtattaaaaaatgagccatctcagaagtggagaccaactgaatatcttcc

SEQ ID NO: 734390 - DNA, 987 bp, Homo sapiens
agagaacttctccaccgaccccgtcacctggattggatcaccgacctctcccaagaggggcctggcttcctcctcgctggggaaacggtagggagctcccctaggtaaagcctctagggagagtggccaggagccgggtcaggaaaggctctggtgcccaaagggctgcccgcagaggctgaggtccctgcaagtgcacagggaggagaggtgagatcagattccagccgagtcaggcttccatgtcagactgcgtgtgtttatgcagaggtgcaactcaggaattactgaggagaaagtacagggccaatttaacctcctctgagagacctctaaccctgctcatcaccactcctcgctaaaaagggccctctccagggaagaacccagagggagagcgggaattctcctccccttggaggaagagtgcttcctctacccttaatgtatcaactgacaacaattcaaacagaaggaaactaggatgtgacaaataaaggaagccttttcatgctctatgtccactggcgtcgggcaagccccggtggaagtccaaggaaaagagtctaagacccaaacagatggtttgcgccaaagttctgaagtgtatcagacgtgaataaaggtatggttttcgattccctgccccctgcccgaggacctgcctcctccctgcccgaggaccaagcttcagaagaactgcacatgggaggaaataccaaccgcttaacttcttcagagacaacctctaacccggctcaccaccacgctagctaaaaaagggccctctcccagggaagatcccggaggaagagtgggaattcaccctccccttgggggaggagtgctttctctacccttaatttatgaactgagaaaaatcctaacaagcctactatgaaataaagatgcccttaacccatttatgcctagtgttccattattggaacgctaagcttgtgggagttatttatatcctactgctca

SEQ ID NO: 734391 - DNA, 956 bp, Homo sapiens
agagaacttctccaccgaccccgtcacctggattggatcaccgacctctcccaagaggggcctggcttcctcctcgctggggaaacggtagggagctcccctaggtaaagcctctagggagagtggccaggagccgggtcaggaaaggctctggtgcccaaagggctgcccgcagaggctgaggtccctgcaagtgcacagggaggagaggtgagatcagattccagccgagtcaggcttccatgtcagactgcgtgtgtttatgcagaggtgcaactcaggaattactgaggagaaagtacagggccaatttaacctcctctgagagacctctaaccctgctcatcaccactcctcgctaaaaagggccctctccagggaagaacccagagggagagcgggaattctcctccccttggaggaagagtgcttcctctacccttaatgtatcaactgacaacaattcaaacagaaggaaactaggatgtgacaaataaaggaagccttttcatgctctatgtccactggcgtcgggcaagccccggtggaagtccaaggaaaagagtctaagacccaaacagatggtttgcgccaaagttctgaagtgtatcagacgtgaataaaggtatgctgcctcctccctgcccgaggaccaagcttcagaagaactgcacatgggaggaaataccaaccgcttaacttcttcagagacaacctctaacccggctcaccaccacgctagctaaaaaagggccctctcccagggaagatcccggaggaagagtgggaattcaccctccccttgggggaggagtgctttctctacccttaatttatgaactgagaaaaatcctaacaagcctactatgaaataaagatgcccttaacccatttatgcctagtgttccattattggaacgctaagcttgtgggagttatttatatcctactgctca

SEQ ID NO: 734392 - DNA, 1789 bp, Homo sapiens; identical to SEQ ID NO: 304023

SEQ ID NO: 734393 - DNA, 637 bp, Homo sapiens; identical to SEQ ID NO: 304022

SEQ ID NO: 734394 - DNA, 941 bp, Homo sapiens; identical to SEQ ID NO: 304027

SEQ ID NO: 734395 - DNA, 1475 bp, Homo sapiens
accggccactgtacgggcctttctggacttggactccttgggagtcgtttctcggccatttgacccgtgggacttgtgggttttgtgctgctttttctttctttcttccccttttccaacttcagcaatacacccagatgttagtcgagtcacgtcccgccgccctctgcccttgaaatgctggcaagtacgcagccccgcgatcgtcacgtgacgccggggttcagcgtatccttgctgggcaaccgtcttagagaccagcactgctggctgcaccatgaatgtgatctacccactggcagtccccaaggggcgcagactctgctgtgaggtgtgcgaagccccagccgagcgggtgtgcgcggcctgcacagtcacttattactggtctgggccgaatcgttcaggctgaagaatatctattccaagcccagtggacagtcctcaaatcaactgactgtagtaatgccacccactctttactgcatcggaatctgggacttctctatatagctaagaaaaactatgaagaggcccgttatcatctggccaatgatatttattttgccagttgtgcatttggaacagaggacattaggacttcaggaggctacttccacctggctaatatattctatgaccttaaaaagttggacctggcagacacattgtacaccaaggtctctgagatctggcatgcatatttgaacaatcactatcaagtcctctcacaggctcacatccaacaaatggatttactgggcaaactatttgagaatgacactggcttggatgaagcccaagaagcagaagccattcgcatcctgacttcaatcttgaacattcgagaatctacatctgacaaagccccccaaaaaaccatctttgttctgaagatcctggtcatgctttactacctgatgatgaattcttcaaaggcacaggaatatggcatgagggccctcagtctagccaaagaacaacagcttgatgtccatgagcaaagcaccattcaagagttattaagtctcatttcaactgaagaccatcccattacttagtgacccatgagctctgcatcaagggttattccaggggctactgaagatctaatatattccagccttgcacaactgctttgaggtactgtagactgctgaagtttccaccctcttcccctgggattgcacacatagctgttatttttttcttacacagcatattaagggaatataaagctttaggcatagaaatcactaaaaactgtgtttgtcatgacctttgtacttgatttatcatgactttgtatgactgagtaatatgtagtcagatcactaatatggtatttgtaattaaactacaaatagtttgtcatttcccagaagtcttccaacgatgcatgtttcatacacttttgctaaaggaggggtaaaggagggggtagggaataaagctatattggaacaaaaaaaaaa

SEQ ID NO: 734396 - DNA, 425 bp, Homo sapiens; identical to SEQ ID NO: 64622

SEQ ID NO: 734397 - DNA, 944 bp, Homo sapiens
attcttgacatattgttcgcaatttgcagctcagctagaagaagcacttaaagaagaacaaaatgtatgtattctttttcttaaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacaaactgctcattcaatgactaatcgatttaatgccatgttgaaagtatttgaaaaccaggcaaatatgttggagagaaacagacatcgtggtcttcagcatctcatccacagcaccaatggaattctcaaacgctgacaaatactcgtgaatttctactggatagtcttcattaatttcttcacctgccgttatggctgactcacggccttcgactccagcctcccggaaagcggtcgggcaacgatgacgacaatgacgcgccagctctgcccgcgccaccagcggcgctttccgatgatctcaccaatgtatagctttttatacacaaattacataccaataaagtgatttaaaagtataggataaaatatagaaactaggattttattaaattattatgcataaatttatatagtagcaggataggacaatcatgttggtctttgggggagctaatagacatattcttcaggatcttgtcagtgcattgtctagctgttcacctgtgcatattgagaaataaataaataggcatag

SEQ ID NO: 734398 - DNA, 841 bp, Homo sapiens; identical to SEQ ID NO: 63778
  misc_feature (28)..(28): n is a, c, g, or t

SEQ ID NO: 734399 - DNA, 531 bp, Homo sapiens; identical to SEQ ID NO: 63779
  misc_feature (28)..(28): n is a, c, g, or t

SEQ ID NO: 734400 - DNA, 964 bp, Homo sapiens
gaaggaggagtgatcatggctacctcagagctgagctgcgaggtgtcggaggagaactgtgagcgccgggaggccttctgggcagaatggaaggatctgacactgtccacacggcccgaggagggctgctccctgcatgaggaggacacccagagacatgagacctaccaccagcaggggcagtgccaggtgctggtgcagcgctcgccctggctgatgatgcggatgggcatcctcggccgtgggctgcaggagtaccagctgccctaccagcgggtactgccgctgcccatcttcacccctgccaagatgggcgccaccaaggaggagcgtgaggacacccccatccagcttcaggagctgctggcgctggagacagccctgggtggccagtgtgtggaccgccaggaggtggctgagatcacaaagcagctgccccctgtggtgcctgtcagcaagcccggtgcacttcgtcgctccctgtcccgctccatgtcccaggaagcacagagaggctgagagggactgtgacttgggctccgctgtgcccgccctgggctgggcccttcctggctaggactgtggaggggagctgctggccatggctgctttgtagtttgcccagagttgggggctaggggaggggggagccagaggccaggatgcctgagccccctgagttcccaaagggagggtggcagagacagtgggcactaagggtggagagttgggggccagcacagctgaggaccctcagccccaggagaagggacaaaaggtactggtgagggcaagaggtgcctgggaggagtggccctgatccaggaaaatgtgaggggaatctggaacgctctaggcagaagaagctgggagggagggggaggtgaaaagggcagaggcaaggatggtggggcccccagcaccctctgttagtgccgcaataaatgctcaatcatgtgccaga

SEQ ID NO: 734401 - DNA, 411 bp, Homo sapiens
gaaggaggagtgatcatggctacctcagagctgagctgcgaggtgtcggaggagaactgtgagcgccgggaggccttctgggcagaatggaaggatctgacactgtccacacggcccgaggagggctgctccctgcatgaggaggacacccagagacatgagacctaccaccagcaggggcagtgccaggtgctggtgcagcgctcgccctggctgatgatgcggatgggcatcctcggccgtgggctgcaggagtaccagctgccctaccagcgggtactgccgctgcccatcttcacccctgccaagatgggcgccacggagggggaggtgaaaagggcagaggcaaggatggtggggcccccagcaccctctgttagtgccgcaataaatgctcaatcatgtgccaga

SEQ ID NO: 734402 - DNA, 559 bp, Homo sapiens
gaaggaggagtgatcatggctacctcagagctgagctgcgaggtgtcggaggagaactgtgagcgccgggaggccttctgggcagaatggaaggatctgacactgtccacacggcccgaggagggcaaggaggagcgtgaggacacccccatccagcttcaggagctgctggcgctggagacagccctgggtggccagtgtgtggaccgccaggaggtggctgagatcacaaagcagctgccccctgtggtgcctgtcagcaagcccggtgcacttcgtcgctccctgtcccgctccatgtcccaggaagcacagagaggctgagagggactgtgacttgggctccgctgtgcccgccctgggctgggcccttcctggctaggactgtggaggggagctgctggccatggctgctttgtagtttgcccagagttgggggctaggggaggggggagccagaggccaggatgcctgagccccctgagttcccaaagggagggtggcagagacagtggcaccctctgttagtgccgcaataaatgctcaatcatgtgccaga

SEQ ID NO: 734403 - DNA, 793 bp, Homo sapiens
gaaggaggagtgatcatggctacctcagagctgagctgcgaggtgtcggaggagaactgtgagcgccgggaggccttctgggcagaatggaaggatctgacactgtccacacggcccgaggagggctgctccctgcatgaggaggacacccagagacatgagacctaccaccagcaggggcagtgccaggtgctggtgcagcgctcgccctggctgatgatgcggatgggcatcctcggccgtgggctgcaggagtaccagctgccctaccagcgggtactgccgctgcccatcttcacccctgccaagatgggcgccaccaaggaggagcgtgaggacacccccatccagcttcaggagctgctggcgctggagacagccctgggtggccagtgtgtggaccgccaggaggtggctgagatcacaaagcagctgccccctgtggtgcctgtcagcaagcccggtgcacttcgtcgctccctgtcccgctccatgtcccaggaagcacagagaggctgagagggactgtgacttgggctccgctgtgcccgccctgggctgggcccttcctgctgaggaccctcagccccaggagaagggacaaaaggtactggtgagggcaagaggtgcctgggaggagtggccctgatccaggaaaatgtgaggggaatctggaacgctctaggcagaagaagctgggagggagggggaggtgaaaagggcagaggcaaggatggtggggcccccagcaccctctgttagtgccgcaataaatgctcaatcatgtgccaga

SEQ ID NO: 734404 - DNA, 1167 bp, Homo sapiens
gagagagagagagagagaactagttctctctgcttctggcatgggcagcctggaggaggagggcaccatggaggaggcgggagaggaagagggggaagacggagacgcctttgtgacggaggagtcccaggacacacacagccttggggatcgtgaccccaagatcctcacgcacaacggccgcatgctgacactggctgacctggaagattacgtgcctggggaaggggagaccttccactgtggtggccctgggcctggcgcccctgatgaccctccctgcgaggtctcggtgatccagagagagatcggggagcccacggtggggcagcctgtgctgctcagcgtggggcatgcactgggtccccgaggccctctcggcctctttaggcctgagccccgtggggcgtcaccaccgggaccccaggtccgtagccttgagggcacctccttcctcttgcgggaggccccggctcggcctgtgggcagtgctccctggacgcagtctttctgcacccgcatccggcgttctgcggacagtggccagagcagcttcaccacagagctttccacccagaccgtcaacttcgggacagtgggggagacggtcacccttcacatctgcccagacagggatggggatgaggcggcacagccctgatgctgctgccatggtggcttggggcagcggggagaaaggagtgtccttgaggcctaggacgctgcccggcctcagcagcagccctgggagcctcctgagggccctccctgtccctggccacgggcccttcttacctcactcaacttcagccaggaggactgggtggtgcttgcaatgttggaatgaccggctcaaagacctcagctctgggctgtttcctgtcagcctggcaggagcctcaggactgtggacgaaggatgtggccttgggcatttgtcctgttcccacatgggcctggtccctccctcctggccccagccacagctgccaggcctgacatggccttgcctctcctgcagtcttggtgactgagacccttgggtggcgcttcccagctctgcaggccctcctggccttttctgcagggtggacacagggtctgtgtgtgggcagcagcccctgtctctcagcaagaataaagcagcttcctgtgcaaaaaactgatt

SEQ ID NO: 734405 - DNA, 472 bp, Homo sapiens
atattgggagaaggtaaagttgagtaacaagaaaccaaccgtgtgtgagagggggattggaaaaaaatttgagggagaagaatgttagaatggaagggaatgatggtggaagggaggtgtgagggtgtgtgctgagtgttgaaagaacggttggtgtctgtgtgattttccttgagtctgttcttcagtgtgtcttctgcagcttgccatgactgcctgggaaagagtagggaaatacccagagccaaaacctcctttcagtcccaccccatccctcaaaaccccagctattgcttcttttcagcttcaggtcctgatctccaatcttagtatggactcccttctcaccaagaccaccaccagctacgtttgctgtgtaatctggaaagtgataatttcctttgcttgttgggtgtgagtcacaatactttggtttgtgcacaagaataaatttatgccccataccttctgt

SEQ ID NO: 734406 - DNA, 2284 bp, Homo sapiens
gccccaccatcgtttccccgcgcgcaggtccgcggggaggggcggcctgccgaccggcccaccccagggcgttcctgaagggcgtcctcggccgcccccaccgcctcccagatgtactatgcggtttcccaggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgatttttt

SEQ ID NO: 734407 - DNA, 1918 bp, Homo sapiens
gccccaccatcgtttccccgcgcgcaggtccgcggggaggggcggcctgccgaccggcccaccccagggcgttcctgaagggcgtcctcggccgcccccaccgcctcccagatgtactatgcggtttcccaggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgatttttt

SEQ ID NO: 734408 - DNA, 1938 bp, Homo sapiens
gccccaccatcgtttccccgcgcgcaggtccgcggggaggggcggcctgccgaccggcccaccccagggcgttcctgaagggcgtcctcggccgcccccaccgcctcccagatgtactatgcggtttcccaggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgatttttt

SEQ ID NO: 734409 - DNA, 2178 bp, Homo sapiens
gccccaccatcgtttccccgcgcgcaggtccgcggggaggggcggcctgccgaccggcccaccccagggcgttcctgaagggcgtcctcggccgcccccaccgcctcccagatgtactatgcggtttcccaggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgatttttt

SEQ ID NO: 734410 - DNA, 2868 bp, Homo sapiens
ccaccccaagctgggaaaataagcttctccctcccatatgtgggggcggccccctcctgagacctgtcatcacttagggggagttgggcaaaacctcctaggaaggtcctggacgcctccaccctgccccacaaggctccgtactcccacctgcctgggcagccctcacacccatgctccctcctttaggcaggcccagaaaggtgccccttcctgagggtgttgggggatggcggcagagagacagctggtattaggagcttccccatcctaatgtgcaggaccaagttgcccgctctgccagccaggggctccaccatgctggcacaggcatctcagaggtgtgagatgaactccgcctcatgcaggatgcccagggctcggaagcagtaaggaggatgctacagaaaggaactgcagaaagaaaaaaagccacatggttaacttttcccctggagggcaaaggggtccggctctcaaaaagaaaagccaggcacagatcccaacaccaagtgtaaggcagcacaaagtgggtctgaaaccccaggaccgggtcaaaggccttccgaaggcccgaggttcttgaggaggaggggaagctgatagggccctggtctttctgcaccagcgtggctctttaaaatacaaaacacccacaaagccaaaaaccctgaaacatgttctttagctaaccccttccctgcccagatgcctgcaattctgagaattcacttcagttttgccagatccaacccctaggcttgagggtggagagccaggcctcctcagggtcccttctaggctcccaggcccaccttaggctttaattgcattggctgtttcttatggtgttagtgaattttgcaaagaaagccctgagcattgcataaatgcttgggggcgtgtcatttaaatggaagttctccaatagtggctgaaggcagagtttactgttatccctccctcttgctggctttgctggagggcttttatcagagagattggaggtgggagagcacttttaaagcacaccccaccccctgcacccgagcggcacctaagcttcccagagaccatgaccttgtatgtggctggaggcctcaggcttagggagcagcctgaagcctttgctgtcaaccctcccaggaaagaagccgggcctcaggctgaggaaaaacagagtttcctctccagagggctcaatgagcagccgggtagtggcctcgggcagtcctcaccagggggacacctccctgctttgcattaactcatcagcaagctcatcgagagctaacgtgggcccagcagtcctgtgcttggaaatgatgccgtcacctccacactcctgctgttccagcctctgcaggtgaagctgcaaggtgagcagaggcaggcgtggggacacactcttcaaggactgcactgccccttctccctcctgagagctctgtgcactgggtttggggatgaggcgccagcctggtcaggggaggtgactgtggtccttctgaccagcttggatctttaaaataatcacaaaaaagctcagcctgagcaggtgggtgcaaggctcaggggcctgtgtttttcatcaatcagttttcttcctgcaagattcttagagctggatgttcacgggatcatggggcatggaggtggtcacgctcagacagtcatgcaccaccctcaatcccaggccctgcagagataggaagaatcccaaccagagggattcttccccaaacgttcccttgtggcccaagagtgagttccggcctgagtgctgttatgactgccggcgtctctccgactgcctctcgcctcagtttaaccatctataggttaggaacaaagaagggcttaggcagccatcgtttccccatttctgtcagagccaagggcttggaggcccagccccatccgggcaagggctgtccgctcctgcccaggcctcacctcctcgctgcagctggcaagattctttctagcagaacagaaacactggcccccaattccactctcccctcctgatgctaccgcagagggcagaaaggtgccctgtagcgtccaccatgtgtgtgtcctgagtttccagtgcaagtcatctggatttgcatttagctagggaaactcggccctcaaaccctctccctctctgcctgaatttgccaaaatgccaaccatccgggcaggtgtggatgccacagtccatccccattgcatttcacccccacatggacagaggcacacactcgcacacattcccagcacctttgactgctgggggatgcaggccagggtctgcctggagcctcagggttgggacttatctccaaaggagcccacaccccctcttccaggatgggcactggctggcagcacttttttccctcatcacatccctgacccctgcccagcccacatgcacatgctgtttcctgtctccagggccctagcctgtggatctcttcctcccatgcactcctagggtgaatgggctcagcaccaaacctggctgtgcccattccccacaaccccagcttggcctcctgtgggaaggagaaggcagacctgcccagaggagaggggcagtgttcccacccacctgctccagcacaggaaccagggaggaaagaagggagagggaggttccattcaccgtcttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggt

SEQ ID NO: 734411 - DNA, 2146 bp, Homo sapiens
ccaccccaagctgggaaaataagcttctccctcccatatgtgggggcggccccctcctgagacctgtcatcacttagggggagttgggcaaaacctcctaggaaggtcctggacgcctccaccctgccccacaaggctccgtactcccacctgcctgggcagccctcacacccatgctccctcctttaggcaggcccagaaaggtgccccttcctgagggtgttgggggatggcggcagagagacagctggtattaggagcttccccatcctaatgtgcaggaccaagttgcccgctctgccagccaggggctccaccatgctggcacaggcatctcagaggtgtgagatgaactccgcctcatgcaggatgcccagggctcggaagcagtaaggaggatgctacagaaaggaactgcagaaagaaaaaaagccacatggttaacttttcccctggagggcaaaggggtccggctctcaaaaagaaaagccaggcacagatcccaacaccaagtgtaaggcagcacaaagtgggtctgaaaccccaggaccgggtcaaaggccttccgaaggcccgaggttcttgaggaggaggggaagctgatagggccctggtctttctgcaccagcgtggctctttaaaatacaaaacacccacaaagccaaaaaccctgaaacatgttctttagctaaccccttccctgcccagatgcctgcaattctgagaattcacttcagttttgccagatccaacccctaggcttgagggtggagagccaggcctcctcagggtcccttctaggctcccaggcccaccttaggctttaattgcattggctgtttcttatggtgttagtgaattttgcaaagaaagccctgagcattgcataaatgcttgggggcgtgtcatttaaatggaagttctccaatagtggctgaaggcagagtttactgttatccctccctcttgctggctttgctggagggcttttatcagagagattggaggtgggagagcacttttaaagcacaccccaccccctgcacccgagcggcacctaagcttcccagagaccatgaccttgtatgtggctggaggcctcaggcttagggagcagcctgaagcctttgctgtcaaccctcccaggaaagaagccgggcctcaggctgaggaaaaacagagtttcctctccagagggctcaatgagcagccgggtagtggcctcgggcagtcctcaccagggggacacctccctgctttgcattaactcatcagcaagctcatcgagagctaacgtgggcccagcagtcctgtgcttggaaatgatgccgtcacctccacactcctgctgttccagcctctgcaggtgaagctgcaaggtgagcagaggcaggcgtggggacacactcttcaaggactgcactgccccttctccctcctgagagctctgtgcactgggtttggggatgaggcgccagcctggtcaggggaggtgactgtggtccttctgaccagcttggatctttaaaataatcacaaaaaagctcagcctgagcaggtgggtgcaaggctcaggggcctgtgtttttcatcaatcagttttcttcctgcaagattcttagagctggatgttcacgggatcatggggcatggaggtggtcacgctcagacagtcatgcaccaccctcaatcccaggccctgcagagataggaagaatcccaaccagagggattcttccccaaacgttcccttgtggcccaagagtgagttccggcctgagtgctgttatgactgccggcgtctctccgactgcctctcgcctcagtttaaccatctataggttaggaacaaagaagggcttaggcagccatcgtttccccatttctgtcagagccaagggcttggaggaaagaagggagagggaggttccattcaccgtcttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggt

SEQ ID NO: 734412 - DNA, 3603 bp, Homo sapiens
ccaccccaagctgggaaaataagcttctccctcccatatgtgggggcggccccctcctgagacctgtcatcacttagggggagttgggcaaaacctcctaggaaggtcctggacgcctccaccctgccccacaaggctccgtactcccacctgcctgggcagccctcacacccatgctccctcctttaggcaggcccagaaaggtgccccttcctgagggtgttgggggatggcggcagagagacagctggtattaggagcttccccatcctaatgtgcaggaccaagttgcccgctctgccagccaggggctccaccatgctggcacaggcatctcagaggtgtgagatgaactccgcctcatgcaggatgcccagggctcggaagcagtaaggaggatgctacagaaaggaactgcagaaagaaaaaaagccacatggttaacttttcccctggagggcaaaggggtccggctctcaaaaagaaaagccaggcacagatcccaacaccaagtgtaaggcagcacaaagtgggtctgaaaccccaggaccgggtcaaaggccttccgaaggcccgaggttcttgaggaggaggggaagctgatagggccctggtctttctgcaccagcgtggctctttaaaatacaaaacacccacaaagccaaaaaccctgaaacatgttctttagctaaccccttccctgcccagatgcctgcaattctgagaattcacttcagttttgccagatccaacccctaggcttgagggtggagagccaggcctcctcagggtcccttctaggctcccaggcccaccttaggctttaattgcattggctgtttcttatggtgttagtgaattttgcaaagaaagccctgagcattgcataaatgcttgggggcgtgtcatttaaatggaagttctccaatagtggctgaaggcagagtttactgttatccctccctcttgctggctttgctggagggcttttatcagagagattggaggtgggagagcacttttaaagcacaccccaccccctgcacccgagcggcacctaagcttcccagagaccatgaccttgtatgtggctggaggcctcaggcttagggagcagcctgaagcctttgctgtcaaccctcccaggaaagaagccgggcctcaggctgaggaaaaacagagtttcctctccagagggctcaatgagcagccgggtagtggcctcgggcagtcctcaccagggggacacctccctgctttgcattaactcatcagcaagctcatcgagagctaacgtgggcccagcagtcctgtgcttggaaatgatgccgtcacctccacactcctgctgttccagcctctgcaggtgaagctgcaaggtgagcagaggcaggcgtggggacacactcttcaaggactgcactgccccttctccctcctgagagctctgtgcactgggtttggggatgaggcgccagcctggtcaggggaggtgactgtggtccttctgaccagcttggatctttaaaataatcacaaaaaagctcagcctgagcaggtgggtgcaaggctcaggggcctgtgtttttcatcaatcagttttcttcctgcaagattcttagagctggatgttcacgggatcatggggcatggaggtggtcacgctcagacagtcatgcaccaccctcaatcccaggccctgcagagataggaagaatcccaaccagagggattcttccccaaacgttcccttgtggcccaagagtgagttccggcctgagtgctgttatgactgccggcgtctctccgactgcctctcgcctcagtttaaccatctataggttaggaacaaagaagggcttaggcagccatcgtttccccatttctgtcagagccaagggcttggaggcccagccccatccgggcaagggctgtccgctcctgcccaggcctcacctcctcgctgcagctggcaagattctttctagcagaacagaaacactggcccccaattccactctcccctcctgatgctaccgcagagggcagaaaggtgccctgtagcgtccaccatgtgtgtgtcctgagtttccagtgcaagtcatctggatttgcatttagctagggaaactcggccctcaaaccctctccctctctgcctgaatttgccaaaatgccaaccatccgggcaggtgtggatgccacagtccatccccattgcatttcacccccacatggacagaggcacacactcgcacacattcccagcacctttgactgctgggggatgcaggccagggtctgcctggagcctcagggttgggacttatctccaaaggagcccacaccccctcttccaggatgggcactggctggcagcacttttttccctcatcacatccctgacccctgcccagcccacatgcacatgctgtttcctgtctccagggccctagcctgtggatctcttcctcccatgcactcctagggtgaatgggctcagcaccaaacctggctgtgcccattccccacaaccccagcttggcctcctgtgggaaggagaaggcagacctgcccagaggagaggggcagtgttcccacccacctgctccagcacaggaaccagggaggaaagaagggagagggaggttccattcaccgtcttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggttctgtgtgtatcaacttaatttgcatatgaatgagtgttgtgttgtgatttgcagtgttttgacaccgtgattggctttgtttgggtctctcttctttctgtgaaattaactgctgtgcgttttcactgttcttagagaagaccctgagctcctggggttttcttgtctcacttctaccctgacctgctgggagcccaccccaccccagtccagccatgagggtatttccagcctattccaatgactgaaacccttcttggaagaaaacgtctaatgtcggggacgtagggacgcttccagacttgccctggccggaaccctgcagcctggggccccagcccgcctgcagctcagctttccccaacaccctcaggacccagccccagccccggcagaccttccctgggagctgcttaggtggtctccacagcgccctctaggggccaagcagggttccagattctccagccttctgccagctttaaaacccttcactcaagcagcattactgtacatgcaatgaaaaatactatatatgacagtcaaaacctgtgtacatatttccatgtacatatttatacatacacacaccttcctattataaatatataaagcatgacatctctttggcattccaagtttgtgtttttttaaatccttggaaatacggctttggaaacctttttcttcctttccctcttttctatgttgtaataaacattcatgtgaccttt

SEQ ID NO: 734413 - DNA, 1537 bp, Homo sapiens
gcccagccccatccgggcaagggctgtccgctcctgcccaggcctcacctcctcgctgcagctggcaagattctttctagcagaacagaaacactggcccccaattccactctcccctcctgatgctaccgcagagggcagaaaggtgccctgtagcgtccaccatgtgtgtgtcctgagtttccagtgcaagtcatctggatttgcatttagctagggaaactcggccctcaaaccctctccctctctgcctgaatttgccaaaatgccaaccatccgggcaggtgtggatgccacagtccatccccattgcatttcacccccacatggacagaggcacacactcgcacacattcccagcacctttgactgctgggggatgcaggccagggtctgcctggagcctcagggttgggacttatctccaaaggagcccacaccccctcttccaggatgggcactggctggcagcacttttttccctcatcacatccctgacccctgcccagcccacatgcacatgctgtttcctgtctccagggccctagcctgtggatctcttcctcccatgcactcctagggtgaatgggctcagcaccaaacctggctgtgcccattccccacaaccccagcttggcctcctgtgggaaggagaaggcagacctgcccagaggagaggggcagtgttcccacccacctgctccagcacaggaaccagggaggaaagaagggagagggaggttccattcaccgtcttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggttctgtgtgtatcaacttaatttgcatatgaatgagtgttgtgttgtgatttgcagtgttttgacaccgtgattggctttgtttgggtctctcttctttctgtgaaattaactgctgtgcgttttcactgttcttagagaagaccctgagctcctggggttttcttgtctcacttctaccctgacctgctgggagcccaccccaccccagtccagccatgagggtatttccagcctattccaatgactgaaacccttcttggaagaaaacgtctaatgtcggggacgtagggacgcttccagaattctccagccttctgccagctttaaaacccttcactcaagcagcattactgtacatgcaatgaaaaatactatatatgacagtcaaaacctgtgtacatatttccatgtacatatttatacatacacacaccttcctattataaatatataaagcatgacatctctttggcattccaagtttgtgtttttttaaatccttggaaatacggctttggaaacctttttcttcctttccctcttttctatgttgtaataaacattcatgtgaccttt

SEQ ID NO: 734414 - DNA, 5911 bp, Homo sapiens
  misc_feature (5)..(6): n is a, c, g, or t
atgcnnaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctacatcagctccgttgttctgtttggggcctgcattgagggggtcgtcctgcgggacaagtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcagggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctccccaactgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggagccacgcctgttggggctgattcggagagggcgccccgcgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctagagctggagctggcgccacccagacagcgtcaggtgtggctggggtaggtttggaggtctgccagttacgccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtattacttttttagactcccgtctgcacaaaatgcaataaaaataattttattatacccttaaaaaaaaaa

SEQ ID NO: 734415 - DNA, 403 bp, Homo sapiens
agaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctgtatcctgcacagctgtgctgggaccaccctcgggggagggcaagagggagggcagctgaacttgctgccttacctgctggtgcaggaagggtggggagggggaggactgaaccgtggggattctcctttatc

SEQ ID NO: 734416 - DNA, 5857 bp, Homo sapiens
  misc_feature (5)..(6): n is a, c, g, or t
atgcnnaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctacatcagctccgttgttctgtttggggcctgcattgagggggtcgtcctgcgggacaagtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcagggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctccccaactgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggagccacgcctgttggggctgattcggagagggcgccccgcgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctagagctggagctggcgccacccagacagcgtcaggtgtggctggggtaggtttggaggtctgccagttacgccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgtatggcttttactgtattacttttttagactcccgtctgcacaaaatgcaataaaaataattttattatacccttaaaaaaaaaa

SEQ ID NO: 734417 - DNA, 4721 bp, Homo sapiens
ggcctggttttcagtatcaggaaattagagaattattttatcaaggaaaaaacaatggaacatttggggctctgctcccctgtcacccttacagaacttagtcctgtggcaggcacacagttggttctgtagttggtatggagacctgccctggaaatccaggcagcactgctcacctggcatctcctgtccacatcattccaggtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcagggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctccccaactgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggagccacgcctgttggggctgattcggagagggcgccccgcgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctagagctggagctggcgccacccagacagcgtcaggtgtggctggggtaggtttggaggtctgccagttacgccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtattacttttttagactcccgtctgcacaaaatgcaataaaaataattttattatacccttaaaaaaaaaa

SEQ ID NO: 734418 - DNA, 4667 bp, Homo sapiens
ggcctggttttcagtatcaggaaattagagaattattttatcaaggaaaaaacaatggaacatttggggctctgctcccctgtcacccttacagaacttagtcctgtggcaggcacacagttggttctgtagttggtatggagacctgccctggaaatccaggcagcactgctcacctggcatctcctgtccacatcattccaggtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcagggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctccccaactgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggagccacgcctgttggggctgattcggagagggcgccccgcgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctagagctggagctggcgccacccagacagcgtcaggtgtggctggggtaggtttggaggtctgccagttacgccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgtatggcttttactgtattacttttttagactcccgtctgcacaaaatgcaataaaaataattttattatacccttaaaaaaaaaa

SEQ ID NO: 734419 - DNA, 336 bp, Homo sapiens; identical to SEQ ID NO: 13756

SEQ ID NO: 734420 - DNA, 2490 bp, Homo sapiens
caaaatttcttagtgttgatgttgatagcttctgggttggcaaactggcagttcactctagtcttactgggttgggcaagtccttgcccctagaaaattggggatagctttggccatgggaggagcaagaacactacgcagtcgtaagctctgttttttgttttgttttgttttgttttgttttcggcaccattatgtacgatgaagacttacagccacagcataggggacactttgaggagccctagtatcattgtttgaaatcattgtacagggaactgcaggggtgaacaccattgtaccaatccccgggccagtgtctcatttcctaacagaatcatcccattcttgttcactcttcagtcatcccaagccaaaagggaaaattcgaaacccactgtgacaccccaaccctaatttccaacctttggaggactcacctggggcagaagggagaaagggctttgctgaagtctcaggctgccgagagccatgtatgggcataggagcaagctgatggcatggctcttgacaaggttttctatagggcagcagctgctgctcccaggggaaccctctcctgttgcctccgcagtctattctggggtggaaacaccattctctattatttctctcacatacatgtggatttctaatatcaagttatgtgactgcctaccacttaaggcctacaaaaccacatgggagtttctttattgcgtatgcagccagtcaacatgaatgggaccctagaaactgtgaggagcaggattctctaaggtgctcttagatacggtgtcacttccacatacaagcacaattctcccagttaaggggctggaagacaagcggggcaactggttttgaaaagcccgctggcgtgccagagggggtgtttgcccacaccctccttgaatttaactgccacaatctatccgcagatgtgttttgttctatttcttgtttttcactagcgtttgcgttgcttcctctgaagccagagggtgaaaggccctagcaaagttagttatcagtcaactgatgataactgtgatccttaaagatgaattcccagcctgaggtgacacacagaggttcagcagacgtctcaggatctgtcatatgtcatgttgcttggtgtgaagatggaagaacaaagtccacatcagtttctgctccttcaaacagtgtgtcgatatgaaacattgagatttggcagaaacatgtgcctagtttgcagcaccaaatactggtcttctcagaagtgtttctgtttttttgtttttgtttttgtttttgttttgttttgttttgtttaatttcctcttctggcatcccaatttggatcatttcctctctttctttcctggagaaacaggatggcaggtgctggagcccagagagggggttaccctccagctaaaatgatttaaatggaaaggagaatgacagcaaagcctcacgtgaactttaatgaccttatcaatgacctttactaactgactctttggtacccggattgttgagaggtgagtgggactaaaagccaggatcaagatcaggttgctccacacatttgcagatcaggaaccccgggaatatgagttagacccagaaagtattgaactggacattgaatgaagcttgaggccatgcattgataacatttttagagtctgttacattattttctcaaaaggaacacatgtttactacaaaccatttagaaaataccaataaccaaacagaagggaaatgtctggaaccttccagttgtttaattctgtagaaactgttcacgaaaggctgaatgagtggggacaagtcacagagatctcgccatggttagcaccagggacaagtctggctctaatgtatgttttatgaagtctgattagctttgaaatgcatctttgccagctgaacttgtcatgcactaaacttcccattgatcattagagtgtctacgattaagtggaaaaggtggtcaaccatttggatgtttgactttcacaacatcaagcattggccattgggcgtatctgggcattggtatggaataaacaggatactcagtgaaacatccaaactattgactggatttttcccatggggcatctgtctaagagtcacagatctgagaaatagaaggaccaggtccgtgtggatgctcctagtgcgttcaaataacccttgaattcacccaggtctcattgcatttatttaaagatggagcccattgtcccccctcctcctcagctcacccatggaactagaaattcacaaacctgaagctgaaccacaggacaagaaattaaacagcaacggccacatggcctcttttttcacaggttttgcattgaatgttttagaactttattcccccgccccctcacccatgtataccaaaactggttttattttcattttcctaaattattttctgatacaataaactgttaactgtttatttatacttttaaaaaaaaa

SEQ ID NO: 734421 - DNA, 411 bp, Homo sapiens; identical to SEQ ID NO: 728869

SEQ ID NO: 734422 - DNA, 1892 bp, Homo sapiens; identical to SEQ ID NO: 15788

SEQ ID NO: 734423 - DNA, 1664 bp, Homo sapiens
atcacattgaatggttaatttatttttaattctatgaaaggagctggagagagagaagtaaaatattcaggggattttctgtgttttaaaagagaaaacctcctgattgcaagctctaaaataaatgctaagatttgtcacactttcagcccacgggagatttgcttttctcgcatagtatggactcaccaggatctgaaattaggggctttccttagaggtggcctcaggctttcctacccccacagttggattatgcagagaaggtcactgggtcctgaggctgctgccgagcgtgctgtcccgggtggacagcgtgccctgtcatctttcattaggatgtgtgtgcctgtgccgcaccagccacaggtcaggatgccagcccctgcacgccctgcgtgctcatttgaaaactgagggtatctgggaagtcaccttacaaggtgccgaggagcagatggctaatttaaaggcaatctgtatgtgctctgagcctcccaaattatccatttcttgaatcctcaatgtgtgaaattcagcacactaagtcctcacaggctaggaaatcaaatgctggacaggccattccctaccatcatctggagtattcagagtatttggaatattcacagtcttcaaggtgtagctgtcgggctctgtgaaggataccttgcatttatagggatcgtcaggtctcctcttcctacgtatttgaagtattatggcttggagtactttctccaccaatgaagaaaagtttatatggcctctcctacgctcttgtcttgtcccaaaagtagggcttaactctgtccttgccatcaatctgtgcacatgttatggagtgaccatggtgaatgggcgatagaggttccttcctaggagaaactttcccagcttccccaaatgtgagaggggcgcctctctcccgaattccccagagccctttcctcccttccctctgccctcacctccctggatgcttcaggatactctgtggatactcttccgtgctccaggagagcatggccccgtggctgatagactcagctctcacccctctaagagctgctcatgagtatcctcgagtggatgagtgaacagatttctaactcaacagacataaatccccagtggagcttaagttaaatgcctggtttttaaattaagaaatatgacttcagcaatatgtataaaccaaaggaacattaaactaatgatagtatctttacaaatgagttgttgaggatttggagatagtttgtataacataaaacataacaaatacagtagaaagcatatggtagtgggattgaagaaacccgagaggttatttatcccaaacaccacctgatgttacagtgcttattgagtgattgatactgtgtcctacgtagagggggcacataaacaattcacatgtaatttttctgtattacattgacagatatatataaaatgatctctgcatctaaaattcaagcagtccagcctggaatactatcaccaaaaagtgaaaactgattttagaaacgaataatattttgttgtgaacaactctgaaaacatactggtcgatgaggtttatagctagagtctaaaatgccacatttatatgggtgaaacattttcagcttcaggagaaaataaaaccaaaaaaaaaa

SEQ ID NO: 734424 - DNA, 3524 bp, Homo sapiens
ggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaagtgccccaagccctccgcgcaggagatcaccaacctggccgacagcctgcagctcgagaaggaggtggtgcgggtctggttctgcaatcggcgccaaaaggagaagcgcatgacgccgcccgggatccaacagcagacgcccgacgacgtctactcgcaggtgggcaccgtgagcgccgacacgccgccgcctcaccacgggctgcagacgagcagggccgccgccgccgccgcctccgcagccgccgtcagcaccgccgccgcccctgccgccgccgccgccgccgccgccgccgctgccgccgccgcgccgaccctgcacctgggccgctccgggctccagcccaggcccatccgccgccctcccctccacccagagacaggcatgcccgcccttggaggagaaaacgcgggagaaacggaccaaggaggcatttttgcactgcctaaagagatccacggaaactttatttcctgggagcgacctgagagaaaacagaggcaccaggttccatcaggggacgacacccgaggccgccgagccaggcccggccgcgtacccaggctttgacggctgccattcagggtggacgatgcctaaagattccaccgctaatattttttttattaatattttttattttttatttctggactgactcagataaaggaatttagaaagactgagcaccagccgctgcacttctctggacttctctcctcaatccgttgccaactttgattgaatgggtgctgtggatgtgattatataatactgccatttccaagcagtgtttttggtaggttttaataaacagacttttcaaaagacggcaatatagaattgttagatccgttgttgatctaaaaatatttgctttatattttcattaaatgacttcttttaatattttattcagaatacttatgaactgctgcaaaacggtaatttatttttccccagatcttgtattacgtgtttttttcagacgagcacaaatcaaaatgaaatgaaaatatggacagttgttaggtaataagggtatcttttgatgtgatcatttgattgtaatttaatttgagtagtgattccgtaagagctgatcgagaaaataaatttgttagaatgaaatagtctgtgtctgatgcgtaaacactgtgtgggaagaaaagagttctttaagaaatatttttttactaatgaaaatccctaagtaatagcgttgaggaagtagagcctgctccacttaaggtacttttggaaatctagagtaaagcataggcattgctgagacagctagtattttaacatagtagtcactcctcgataatccataaattcacaatatttttctctcccttaattttagtggatgtctttagtgttttcaggtgagattgcctaaatattaacccttttcttggcgatacctgtgtttcttatcgaaagattgaacgatatcaccagtaaaaatgagccaactggctattaatggttaatacagcccctccccccaagttcagcttcttttttcttctcctgtccccctcccaacatgttcctgtctcttttctctttttctcaagactatagttgttaggagtcgcttataagtcttataaaatattttgatatcaattacttcccatcaataactatatgtaattaaatttaaattattaagctttttgggttttttccccccgtaataaaagaatatagttctaaaatcctgattatggtccacactgcataccatctgtgcaattaccaactcagacttaaggttctatatttctgtgtttttgtctctccccagtatgattctatatcttctttactggtgctgggggttttaggtcaccttttacataaaccctgcagagtggtcacattgatcaagttaatgtttcaatatttacaatgtgggaaaatgaaagtgtaatgcctcaggttgtgagtacttaagacgctaaaggctcggcttagttgagtccctatatattgtacttaaaagtatttagcagtggtagagcaacgattttatagacaaattccccccaatctcacttagctgtcactcactttttttcctccttctctcatcttcactccctctccctgtgatatcaatgcaggggttaaaaaacccggaaaactgtgagagcaacaaggcacagttatttctcccagacaggccctgtgtcactttcataaatcaaacccagccagatggccatgtattgggttgcattattttaaacaccaaatcgtactaaaaatcacaatcattttgatttgtgaaatctgaaaaaggccacatatattaaacagagagaagaaaaaaatgaagacaagaaaccacaatttacttttctttgccttcttgttccctatttctcttgctgctgtaatccctatgcccagcaaatttacaacctggagtgggggtgggggagaagttcaccattttgggggtgtctagagaggcaagcaaagaagtcctcattggaaagctgaggactggtcaggttgtttttatgtggtggatactactggcacgtgagatggaatcttgtttttcctatgggaatggtggtggttgattagacaagtaataggtctattaaaaaaatttcaggaggtatctacttagttgatttagctgacaacaaaagagctaacattagatttcacactgttttctattaaaaagcaaactttgctgattactttggaagaatccctgatttgggggtagcagagtaacttttaattggagaagctgggaaagcaaacccattttgtttcattatttgcattttataaagtgagctaatgcttgcactccattttttttaatcaaccctttcaatgtaattacaaaatgaaattcatggttgaaaaacaaaagagggcagatataactgagaggttttgtgctaaggcttatattgttacacatgtaaataatgaaaatattgttatatatcaccagatctttttaatgaatttggtcattgtgttcctttgcagtgcaagtgtcttgtgcttcgtaaagtgcccatttgtttcctccatttcaatccaaccccccctccccttccaacccaaaggaaagtgacaaagttctgttccatcagccttgctaatcccaagctaggcccacttacagtttacagtctcctgtggctcttgatcagttgtccaagcctccgtcgctcccacaaccatcttcccctggcaagtctgtgcgataaatcattcaaggtgtattgaaaatagtcactttgcta

SEQ ID NO: 734425 - DNA, 518 bp, Homo sapiens
ttccacttcctattcctattccctattttctattccctattcctatgcgaaattcctgctgaggtaagtaaccaaaaactgtaagaatgattaacaaaaaacgaaaacctaaaatgtgttgatgccttagcattatggaaatgatgtaaacacctttgaaaaggagtgaagaagcctattggcttcactaaagatatacacaggcactaaactagaggggtgccttaccagaggtatcaggcttagtaacattctaggaatatttgaaggaatactgttatatatttaaagtataatattatatagaacaagtgtataaaaaactgtcccaaatactaacagagtataggtagagaaaaataaaggccagtgtcttctcagtatcatgttagtattatttcagacctcattaaagaataatatttaacgtgaagaacatgagtaataaatcaatatgaagaataaattctaaaattttaaacaatgaataatgacaatactttatttaaaaaaaaaaa

SEQ ID NO: 734426 - DNA, 503 bp, Homo sapiens; identical to SEQ ID NO: 23519

SEQ ID NO: 734427 - DNA, 4350 bp, Homo sapiens
gtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtcttgatgactgtttgcagcagtatattaagaactttgagagggagaagatcagtggggaccagctgctgcgcattacacatcaggagctagaagatctgggggtcagccgcattggccatcaggaactgatcttggaagcagttgaccttctgtgtgcattgaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtcaccatttgctgctgtgacagactattcagttacaagaaataatgtcatacaactctgcctggagttaacaacaattgtgcaacaggattgtactgtatatgaaacagagaataaaattcttcacgtgtgtaaaactctttctggagtctgtgaccacatcatatccctgtcgtcagatcctctggtttcacagtctgctcacctggaagtgattcagctggcaaacattaaaccaagcgaagggctgggtatgtatattaaatctacatatgatggcctccatgtaattactggaaccacagaaaattcacctgcagatcggtgcaagaaaatccatgctggcgatgaagtgattcaagttaatcatcagactgtggtggggtggcagttgaaaaatttggtgaatgcactacgagaggacccgagtggtgttatcttaactttgaaaaagcgacctcagagcatgcttacctcagcaccagctttactgaaaaatatgagatggaagccccttgctctgcagcctcttatacctagaagtcccacaagcagcgttgccacgccttccagcaccatcagtacacccaccaaaagagacagttctgccctccaggatctctacattccccctcctcctgcagaaccatatattcccagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatggcaagctacgacctatatctatgccagtggaatataattgggtgggggactatgaagatccaaataagatgaagagagatagtagaagagaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatacatttcagcagtcctcactgcagcacaaatcaaagaagaaaaacaaaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggatgaaaaagcagaaggattcattagcctgcctgaatttaaaattgatagagccagtgaatgccgcaaaaaatatgcattcaaagcctgtcatcctaaaatcaaaagcttttattttgctgctgaacatcttgatgatatgaacaggtggcttaacagaattaatatgctgactgcaggatatgcagaaagagagaggattaagcaggaacaagattactggagtgagagtgacaaggaagaagcagatactccatcaacaccaaaacaagatagccctccacccccatatgatacatacccacgacctccctcgatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagctaatacactgcgagagttggtagaacctctccatgccaaatcggatccacttctgttggcactcaacccattggactcacagattgataagctaatgtttagagaatttagatcggagagagtcggtacggcgcagactcaacatcaacctcttgcaagcaactaaaatggcctcgtccttgctgtttataacagaaaacagacttgtaaaaagcttagatcatcaagtgttttggattgggggcctcccaaagggatataagaggggcaggccactcttaagaagaatgcgagctttctacattgggactagcataagatcaaagccaatcaagatggagcacagtaacagaaaactgcggtttctgtgggagaacagaaggggaaagggtcttaactgggaaagggctctgtgtggtaacacctcagttgtgttctcctgacaccaggaaaagagagggatcagcttcaataactagaaaattctggctgtttaatggactctttggtggcctctttaaggcaaagcagagaaagcaaattatgtattaagtgtattttgcatttttaaaacttgacgtgctgtattgtactaaattaagtgtaatctattaaggcaaggtatacacaatttgctttgaaacttactatgtttattctattataaagtgtattcaggtgcaacacagagactgctttcggtgacattaatgaagaaaatttctcatgccaggctttattatagaatcttcagctaaaatcctaactttctccttatttcttggcacttgtatacaagtggtgttgcctcttagggcaggcatgagctattcttttctgtaaaatattttgaatctataggctgtgggtttcatttttgaaaagtattttgtctggatgtctttcaaactagcttcagatattatttaatactatgtaactgggtcccctatggctcaatcaatattgcttatttttcttctgtagtggatgtgaaatttcctttagttggataagatacactgtaataattttaatgctaattaatgatatttcatactgtgcaatgaacagataatttaacactgtattttgaaatgtttttttcttcctgtcaccgcagtgtgtggtattgcataatgtgaatacctgtaaaaatataaattacttaaaaataaaaatatgaccaattggtatcag

SEQ ID NO: 734428 - DNA, 2630 bp, Homo sapiens
aaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatacatttcagcagtcctcactgcagcacaaatcaaagaagaaaaacaaaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggatgaaaaagcagaaggattcattagcctgcctgaatttaaaattgatagagccagtgaatgccgcaaaaaatatgcattcaaagcctgtcatcctaaaatcaaaagcttttattttgctgctgaacatcttgatgatatgaacaggtggcttaacagaattaatatgctgactgcaggatatgcagaaagagagaggattaagcaggaacaagattactggagtgagagtgacaaggaagaagcagatactccatcaacaccaaaacaagatagccctccacccccatatgatacatacccacgacctccctcgatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagctaatacactgcgagagttggtagaacctctccatgccaaatcggatccacttctgttggcactcaacccattggactcacagattgataagctaatgtttagagaatttagatcggagagagtcggtacggcgcagactcaacatcaacctcttgcaagcaactaaaatggcctcgtccttgctgtttataacagaaaacagacttgtaaaaagcttagatcatcaagtgttttggattgggggcctcccaaagggatataagaggggcaggccactcttaagaagaatgcgagctttctacattgggactagcataagatcaaagccaatcaagatggagcacagtaacagaaaactgcggtttctgtgggagaacagaaggggaaagggtcttaactgggaaagggctctgtgtggtaacacctcagttgtgttctcctgacaccaggaaaagagagggatcagcttcaataactagaaaattctggctgtttaatggactctttggtggcctctttaaggcaaagcagagaaagcaaattatgtattaagtgtattttgcatttttaaaacttgacgtgctgtattgtactaaattaagtgtaatctattaaggcaaggtatacacaatttgctttgaaacttactatgtttattctattataaagtgtattcaggtgcaacacagagactgctttcggtgacattaatgaagaaaatttctcatgccaggctttattatagaatcttcagctaaaatcctaactttctccttatttcttggcacttgtatacaagtggtgttgcctcttagggcaggcatgagctattcttttctgtaaaatattttgaatctataggctgtgggtttcatttttgaaaagtattttgtctggatgtctttcaaactagcttcagatattatttaatactatgtaactgggtcccctatggctcaatcaatattgcttatttttcttctgtagtggatgtgaaatttcctttagttggataagatacactgtaataattttaatgctaattaatgatatttcatactgtgcaatgaacagataatttaacactgtattttgaaatgtttttttcttcctgtcaccgcagtgtgtggtattgcataatgtgaatacctgtaaaaatataaattacttaaaaataaaaatatgaccaattggtatcagatcttttcagatagctaaataatttgctaagtatgcctgatagtaaatatctttctaaaaagaagtaatcagtgcttctttctcacaaatggaatttgtgtctgtgaataaaatcacattgatctgcct

SEQ ID NO: 734429 - DNA, 360 bp, Homo sapiens; identical to SEQ ID NO: 25812

SEQ ID NO: 734430 - DNA, 578 bp, Homo sapiens
ctcgagaacagtcaggcttgctgttgaagggagcgccatgcagcgcttacaagaccacctctcggcagccgcacaaagtgttttctgctatgggtgaaagtgtaatgagaaccgaggcaagaaaggtcggaggcctgatgctccaacttcaaaacgtgggcctgggcagggcagatgagcgagtcactggctagttgataccaatctccttgttatcctcgataaaccgcgtgaatgggcggctggctgctgtttctgagctcgctttgtccaagctgacgatgggtgggctactgccagtgcgtgctttgtccatcccactggccatgctgcccagaggggggagggcgctgcccccaagactcacggggagctgggggatgccgccgttctggatgacggagatctcgttgttcttcatggcgagcccgttagtgatggctgcagcatactggttccaaaaactggggtcgacgttcattgcccgagctgccaggtccttctggaacatttcagagaacttcagggcatcaccccctaggagagccatggggttctccacagacaggcggcggcgc

SEQ ID NO: 734431 - DNA, 5153 bp, Homo sapiens
cacactcgcacccgcgcacgcaccgccagcaggcagcggccaccgccgcgatgctcgcccgcgggttggggaagtttcccgccggcctcggccgcgggcacccgtgctcccaggtgtagcgcccccgcgcggcgcgggcggccggcgcctccagcatgaccggccagagcctgtgggacgtgtcggaggctaacgtcgaggacggggagatccgcatcaatgtgggcggcttcaagaggaggctgcgctcgcacacgctgctgcgcttccccgagacgcgcctgggccgcttgctgctctgccactcgcgcgaggccattctggagctctgcgatgactacgacgacgtccagcgggagttctacttcgaccgcaaccctgagctcttcccctacgtgctgcatttctatcacaccggcaagcttcacgtcatggctgagctatgtgtcttctccttcagccaggagatcgagtactggggcatcaacgagttcttcattgactcctgctgcagctacagctaccatggccgcaaagtagagcccgagcaggagaagtgggacgagcagagtgaccaggagagcaccacgtcttccttcgatgagatccttgccttctacaacgacgcctccaagttcgatgggcagcccctcggcaacttccgcaggcagctgtggctggcgctggacaaccccggctactcagtgctgagcagggtcttcagcatcctgtccatcctggtggtgatggggtccatcatcaccatgtgcctcaatagcctgcccgatttccaaatccctgacagccagggcaaccctggcgaggaccctaggttcgaaatcgtggagcactttggcattgcctggttcacatttgagctggtggccaggtttgctgtggcccctgacttcctcaagttcttcaagaatgccctaaaccttattgacctcatgtccatcgtccccttttacatcactctggtggtgaacctggtggtggagagcacacctactttagccaacttgggcagggtggcccaggtcctgaggctgatgcggatcttccgcatcttaaagctggccaggcactccactggcctccgctccctgggggccactttgaaatacagctacaaagaagtagggctgctcttgctctacctctccgtggggatttccatcttctccgtggtggcctacaccattgaaaaggaggagaacgagggcctggccaccatccctgcctgctggtggtgggctaccgtcagtatgaccacagtggggtacggggatgtggtcccagggaccacggcaggaaagctgactgcctctgcctgcatcttggcaggcatcctcgtggtggtcctgcccatcaccttgatcttcaataagttctcccacttttaccggcgccaaaagcaacttgagagtgccatgcgcagctgtgactttggagatggaatgaaggaggtcccttcggtcaatttaagggactattatgcccataaagttaaatcccttatggcaagcctgacgaacatgagcaggagctcaccaagtgaactcagtttaaatgattccctacgttagccgggaggacttgtcaccctccaccccacattgctgagctgcctcttgtgcctctggcacagcccaggcaccttatggttatggtgtaaggagtatgcccagcccctgaggggagagatgcatgggatatgcacccaggtttcttttacagtttttagaatcgtttttagagggtggtgtgtctgacaccatgcctttgcacctttccatgaaatgacactcactggtctttgcatcgtgggcataaaatgttcaccttttttccagatgagtacacccagaatgctaatttttctgtccatcgtgtacgctattctagtgcttgtggcccagtactgtctatgagttgtcgtgctcctgtttctgaggttgtcgtgtgagttctgtacaaaaagcccccacaagtcgtccagtagaaatgcatctatgaggtcagcaaggatatgatgagattttgctcacagtcatgtgaaaacaaaatctcagctctttatccattgctttcacttagttttagtaccaaaacaaagagaatgcaaagttaagcagacttgaccaatgcaagtctctaagttgtttttataaatgatctgtagttccgtggcttgcatgggtgcaccaatcatctttagaacgatgtacactgatgttcatctcataaatgtcactctttagagaatgttacttagttaaacatgcagtgaagatcgaatttttttcccaagaacagatgtgttagggagaggggcttcagctaaatagtccaaaccctagggtgcttaaagccaagttagtgcaggctgagccccttggttcacagtcaagcctccttgtttcctagggtgactgtagagaaatgtatttccggatgaggtttctgatctaggccatttgaccaaactttgctgtgtctaagatattagcatgtttttgaaatatttattttttaagatgtttaggagtaaggtcgtgttgtcttcctcaactaaaaagaagtttactgttgtatcgtctccctgaggtgaacgttgttgggttgctagcaagggcagtagcttaaatacttttgttgcctactctgaaagctcatcaaatgagagccccttttatttccaagcagaatttagtcagataattttgcttctaggatatagtatgttgtatatgatgctgtgattgccctggagttcctgcccatgacatggaaacctggtggtatggaagcatgtactcaaaatatagacgtgcacgatggtggtgtggcttacccaggatggaaacactgcagttcttacttgcattcccactgcctttcatggggggtgactgggtagaggccaggagaaaggaaagagttgtaaaataaaaaactgctagttcataaaatgtcataaaaaattgtaaacttgaaaagcttaatgctattcaaaagaccttcaagcttccaaacttgtattgaagggagacgactgtttcctcctccaaaatgctcctgctcctcttgttcggttaaccagcacataacattgtgatggggaacctgggttcctctataagataattcttctccatcatctttaaggtaatctgatggttttccaggtggctttcattattgttccatctttgaaaaggcaatagaacccaggggtctgagcatggagctatccagggttttcatccaaaggttgggcctcttcttaagaggtccttttgtgtttcagttgattgaagatgatacttacctcattggaggtgtggcaaggatcttatcagaaggctttgtgttcttgtagttgtcatggctactacagtgtgggtgatttattgaatgaattcactagccacttgtgtcctggagcccccagttcaaatctttccattggactggaggcttgtgggaggctgggaggtggctgtctcctagtgtctacatccgtgtctctgaagcatcaggaaaagtgagatgacttagaggcaactgggcactgaatcagaggagcagagttatttttcagaatttgcacatggaacacttagatttggctggtgcttccagccctggaaggcataacatttacggactcatccccagctgcactgaaggcaggtggtggtacagacttatgaggacggatcagtttgccaaggctgatggtattgggtcactgagcctggtatccatggccgctgaccaggaagcttatgcaaagtggaagcaaggaacaaggcagaataactcagtcactttcatgaagatttttctaaacaagaaggcttaccaccaaaaaagaggtaccctagtggttaccctttgcagatgtgaaagctggaaaacttgacttttctttttggtaatgacttgcatttatctggtgcctttcgttggaggaatcccaacgtgctttagagactatctttttaacatctcttgtacatacatatatacttatataaaatattatcttgcccaactggacctttactcacttctgagcatgagaatgtcccaatagcattgagtttttcaagtggtggtttcagataagtgggagaaagaacaacccggctggcttaaaccctggagctaattcccacaaggaatgtagactgaatggtgacccagggagaaataatcttcctctcccctaaagtctcactaaggtttgaagtttacaggtgctctccactgggtctttgatcgaccttgctagataacatctaaccagcagtttcttttagtccctgaagctaaccagggagagtcaggttaattttctgtaaaaatatgaggtgacatctttggcaaccaggctgtcagactgacctgtaaacctcctttagggggacagagtagaaactggagatgacttgtttccagctgtgagcttgagagaagtgtcactcccagcatttgaaggttattgttttcaatgccagtgggccaaatatatgggccaggctttgatatctgtgatgtgcattttggaagtgctgggttgggaagtgacacgtctgttgcacaaatgcatattggttataggtttgtgttttctgccaaacccccacatttctcgggtttgtgagtgaggaagggcatgttgtaatgccaagctgatttgtagctcgtaaggtagtaattggtatttaacatttgcatttgttatttctacttatcttagcactcaaataattgaactacctgctaattcttgccgcatttcaaagaaaataagttgttatgcactttgggatagtggtgatctgtacaggctgtgtgttagctacttgaaggcgtaactggtatttcttgtgtgttttaacagcatgacttcttacagagctgtaatttttaaaattgaggatgccatatttgagatgtcagttttaacactcattaacacactactgtgcaagcattgacacaggctgcactgaaccattatgtctgattgctgcactttcatctctgtgcctcgattcgggaatgggcagtaatactgacacactcgggactccagcctcaaaaagtgtgcagattaaatagacaaaaattatttgcat

SEQ ID NO: 734432 - DNA, 498 bp, Homo sapiens
  misc_feature (8)..(8): n is a, c, g, or t
  misc_feature (29)..(29): n is a, c, g, or t
  misc_feature (50)..(50): n is a, c, g, or t
  misc_feature (65)..(65): n is a, c, g, or t
  misc_feature (76)..(76): n is a, c, g, or t
  misc_feature (85)..(85): n is a, c, g, or t
  misc_feature (153)..(153): n is a, c, g, or t
  misc_feature (477)..(477): n is a, c, g, or t
  misc_feature (487)..(487): n is a, c, g, or t
aaccacangggtaaaaaattacatttgcntggaaccccggcctaacgatnccctgtaaaatgganactttggcganactcacttncccgggtcaaagtgggaaacaggctgaaaaacaggcctgagcatcctttaatgatgtgcagaaagagnagggccctctgcccccacgggcagatgtacacagctgctaacagagaagcccctcatcctgtacgaccagtgcagagaaacgatcccctcgaatgcttcctagtggagttaagaaattttttgttgatcgtgcctttgaactaaggtcatttaagtatacaacagatgttcctctgagggaaacagacttataaagtcaggaacacagaagggacctaatggtttactaggggtggcgcattaagttcatagcaatttaactcctttcaatgctaaacaaaacaatgacgcaatttgatgcgcaataaaaacttgtcaaaagtntcaacttacnaaaaaaaaaaa

SEQ ID NO: 734433 - DNA, 1464 bp, Homo sapiens
ggcttaaaaagatgaatcgagatgcagtgtgtaggaagcatgggcaagggatgaggaacgccactttgaaaattactaaaactaaagcaagtgactaagagtgtgaatgaccctggctgcaatgactacgcctgctgggcttctattaaaattagactctatttcctgagcacccacaaatggacctgacaaagggaagacacagatgtactgcgtgatgaggaaagcctatcaggattaaaatatggctataactcagcctctccagagtgcagccaccatgacctccgcagattgatgatggaagaaaagaaaaccaggatatcctgtgctctggcttccctggaccatggatggaggacagcccatcccctcatccctagtcccccttgggaacgtatcagcagattctagcatgtccctggagcagaaaatgacatttgtttttgtgattctgttgtttattttcttgggcattctcattgtccggtgcttccggattcttttggatccatatcgaagcatgccaacctctacctgggctgatggacttgaaggcctggagaaagggcagttcgaccatgcccttgcttaggagggatggtgtgggatctcctcctgaggagatgaagtgctttgtgtcttggtgaggattccctttatttagtgttctcaacaaatcaaatttaaacaatatttggtcccaggaccataatccattattccataaatatgcagttgggttaaagacatttgaggatgttggaaatggacacttatataactaatccaacataagaaggtttaaatttttatgtttgctcaatgaatgagtactcttaaaattgtgtgattgtgaaaccaagagcgttaatactgacatagatttgccatcaaacaaaacaccacctgatctgactaaagaataaaagactagaaaggatctcatatgaatctggtgacaaggccaggaagagatttccttgctctaattatgtctatatttgttttatttcatgggcacctatctgggtcctgagcagaatgaggaagattgtgctgaatggacccaaagtagtttcttgttttctcctaaagcagggagctttgggaagcaatggaaaagcttaaaagagatgattctgtccttggtaaatgtgagtgagaatagcgttttgtttttcaagtaaaacttaattcaaaggctacaaagttttaaaaactatttaccaagccaactacattatatgtattcatattaataacatgtgtagaggtagctatacattacttgaatttacactttacacaaatgatttaaaaaataggttgcaagtgcagcttaaagttttttttcaatgaaaagttaattgtttagaggagaagacttttatagtcttcagaggaatgtgtatttatgattgtatatagtcaccaaataaaacttttcaagaaacagaaatg

SEQ ID NO: 734434 - DNA, 2329 bp, Homo sapiens
ataaaaacattgtatatagtagaccaaatggtcatagttactgtgagcctggcagagcagaaaaggcagttgaaggaggcagagaaggggttggtgatacggtgctataaatctgtggtccagtccacctcccttttaagacgtcctccccctatttctgttcttagttagagatgcagcagcttactcctgtagcgacctactaaaaagcaacaaggagaaagacatcgtctttttgaaaaaacgttctttcgtctcttttctttgttccttggtttgtttttcttgcccctttttgtttagttgaacggcaataggagggtagtctctccgtctttttaaactcttttttaagtttcccctcccctttcatatttttttgggccatttcttttagctttggactttgggggtcgaaagcgtttctttttatttgcttcttttaagccgagcacagtttaggtttcgtgctgtcttaagagaactatccagcagcttcttgctcatccttattgggagaactgcaccgttactttaaaaacacacatacacaaaaaccttaagggagaaagaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatacgtagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttat

SEQ ID NO: 734435 - DNA, 2290 bp, Homo sapiens
ataaaaacattgtatatagtagaccaaatggtcatagttactgtgagcctggcagagcagaaaaggcagttgaaggaggcagagaaggggttggtgatacggtgctataaatctgtggtccagtccacctcccttttaagacgtcctccccctatttctgttcttagttagagatgcagcagcttactcctgtagcgacctactaaaaagcaacaaggagaaagacatcgtctttttgaaaaaacgttctttcgtctcttttctttgttccttggtttgtttttcttgcccctttttgtttagttgaacggcaataggagggtagtctctccgtctttttaaactcttttttaagtttcccctcccctttcatatttttttgggccatttcttttagctttggactttgggggtcgaaagcgtttctttttatttgcttcttttaagccgagcacagtttaggtttcgtgctgtcttaagagaactatccagcagcttcttgctcatccttattgggagaactgcaccgttactttaaaaacacacatacacaaaaaccttaagggagaaagaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatacgtagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttat

SEQ ID NO: 734436 - DNA, 627 bp, Homo sapiens
agcccggcatctccctgccggcacggacccgaagggcggtcgggcagggcacgcgccggcggcggccgcggcgccgcgaactcgccgccggccccgcctcctggcgctcttccaagcaagcccctccttcccgccccgctacaaacggcgggaccgcggcgcctgggcgtcactgaggcagtagccggccgggtgaggagggcggttgccggcgcggcgcggcgcggcgcgggtggggcgggggttccgccggcttccagtcccctttcccgccgccgccgccgccaccgcctctccgcggagctcgccccgagcgactcctccgcggcagtgctgacggccagcggcacgagccgtagtagctgcagcttcgagtcacagcagaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacag

SEQ ID NO: 734437 - DNA, 759 bp, Homo sapiens
ccctagtccgaactctgggcgggaacactggtgggggcggcggaggttgtgcccgcgaagttcctagagctcagcccgttgcggcgggagtagagagaattgggcgcctcgggaggtggcaccgcccctcccgtgggcacaagcaggttgggggcggcgggagccgagcggggacagtcgcgcctggcagcgtgcacgggcgtggacgtgcccgggtgcggccgcgtgtagcgcaagaaggaaactgttgagacgcagaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactg

SEQ ID NO: 734438 - DNA, 299 bp, Homo sapiens; identical to SEQ ID NO: 33807

SEQ ID NO: 734439 - DNA, 1211 bp, Homo sapiens
ggcgaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgac

SEQ ID NO: 734440 - DNA, 450 bp, Homo sapiens
ggcgaggccatgtgatgctgggcgagagagagccgccgcgccggagcctccttctttcctgcctctgattccgggctgtcatggcgacccccaacaatctgaccccccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagt

SEQ ID NO: 734441 - DNA, 2648 bp, Homo sapiens; identical to SEQ ID NO: 433215

SEQ ID NO: 734442 - DNA, 2893 bp, Homo sapiens; identical to SEQ ID NO: 433220

SEQ ID NO: 734443 - DNA, 1456 bp, Homo sapiens
ggcgaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggaggaccccgcctggcagcaagtctggagctgagaggagctaaccctcggggacagcttggcagagcccagtgaggagagatggccgggccaccactagaatcccctgtccgccagcagccaagcccgagcatgggggtgcccagggcctctgggcagagacatcttggggctcagggatgccgggggcaggtggccggggcaggtgcccctctggcttccctgcccagcccctggcggtgcccacagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgac

SEQ ID NO: 734444 - DNA, 2474 bp, Homo sapiens; identical to SEQ ID NO: 433221

SEQ ID NO: 734445 - DNA, 1037 bp, Homo sapiens
ggcgaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggaggacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgac

SEQ ID NO: 734446 - DNA, 1191 bp, Homo sapiens
cttgcccccagctcccaccctcagccctgtgactggaatgtgtgccccaccgtcattgtcctgagttgaatgtccctttgtgggggaggtggggggggcagtgtccatccacgaaggggcagaaggagggagccacgtgccccgccccacccgctcgggtgaagcccagtgggatttgcatctttctttctctttggttcctgcacatttatgggctgggaggcatccgtgtggaattgcgtgcagcctgtgtgtgtgctggcacaagcccatgcactgtgtgtgcagacgcatggggcctgcacccacaggcatggccgagcacatgtgtgggggaaggcgtgggcacataggtgcatgtaacctgtttgggcattggcacgtgcctacctgcatgttagcgtgagaggagctttgtgtgtgagaacatgtgtaatgtgtgtgcagacatgccgagagccagagacttgtgtgtgggccacgtacatgtggatagagacgcatacatggaggtgcatgtaatctgtgtctccgagtgtgtgtgtgcaggtatgtgtgctggtgcagacccaagtgtgtgggtgtgcctctgtgtgcgtgtgttccatcatccctgcaccactggctccagatcccttcctgagcccccgtccccgctggccctctcacagcctgcagcacatcagtgcccccagctgcatgcgcctcgctgctctgtccatcagtgtgtgcttgaccaagagaaaactaagacgtctcgggggacccctgtacctggtcctctcagacccccgcccactgtgctgtgttactcgcatgggggatttcctgccccttccacaatatgctgtttccccaggagcctcaggcctgaggctctgagtggggtccccagggggccccccggggtgagccccggctccacaccctgccccatccaccctgtagggcccatgttggtgtagcagtgatggcttctgtggatattctgtgacctctgtcggtgtaacttgacaatttctaaatggaaaagggttgctgtgttttctctgtctctcttttttaatgtccttttttcttctcccccgctccctgctctctttccttttcagtttttctagccaagtgtttggggctttaataaaacttgtttctttttcctctcctggatctccttcctataggctgatg

SEQ ID NO: 734447 - DNA, 1702 bp, Homo sapiens
agcttggcacgagggagggaatgtttgtgaatacatctggtgtgtactaaaaagctggaaaacccctaagtaaatgcaatatcgatagaaagcgagtttcttgaagagtcatctgctaaactccactagagtcatctctacaataacaatatcaactgaatataaaatattaatgccatggatgatctcagaaatgatttcctacaaagtcccaacctatcctggaacatttcttatgtgtgcttgggagattgcaagaggacaactcggctctaaaatcgatgcattaacatgtcattggaattgaccttgccaaaagatgcctccctaaatccacaagaatctccttgtttgaacacagtttctaatccagctgtaatgaagacagacaacagtcaaattaacaactgatcaggaggagaagttcatactccttgagctggatctatctgcacatgcacctggcccaggaagctgaaatgggagatctgatgagcagtggaggactgaaccaaagcccttggcttttgctccataccagtcagagtctcatcaggatatcatgttgcattgagtagtcatgtctccacaggcttttcttggctgcgactcttactcacgttttccttggttttgcccaccttacagtttacagtagtggtcaggtattttgtagtatgtccctcacttgggctttgcttgatgcttatctcctgagaaaactagggatatgtattttggggaggaaggccacagagatgaagtgacattcttttcacatcatatcaatgctacatactatcaaaagggcttatcactgttgatgttaattttaatcacctggctaagatattctttttcaggattttgactttaaagttaccctttatgcttttccttctcataaagtgctctttgaaatgaagtcactctgtgcagcagacatttaaaaagcaggaaattatggtgacagagtatctgtataaattatttgcagttcttttattttcagagtttggaattatagcactcctataaatcttattactaatggtgccacaaattgtgtactactgatatgtattagtgcacaacttaaagcatgtggacatgagctgtatttgaaaaaacattcagatggaagagctacctgatttgaagtgaatcttaattggaacttaatgatgcctcctagtaatttactattttagctgaacctacagtatcagctgtagcccagaaaatataagagctacaattcgtacaattcaacatcagctgccaaggcccacctggactgcacctgcaaaaccagctgtggtttctttgctctcacaattcatgtcagtgtttttcagccaatgcatcactggtttcgaattttatactgtccctctctcagtcctccacccctctagtttctaaatgatagagaataattaggtgaggtttaaactctcaggattattcagggtttgtggagagtaggaaggtttcttccaggttacagcacaatttaaggagcctggcaagaagcatccaatattagcaagtagaaaagcagcataagtatgaggttggaacttcccacgatacttagtacatggaaaaaaatgtagaacataccaaaaaaaaagcaaattgtaaaaaaatttcacaaataaaaatactgttatgaaaattaaattataaaaaaaaaata

SEQ ID NO: 734448 - DNA, 1071 bp, Homo sapiens
agcttggcacgagggagggaatgtttgtgaatacatctggtgtgtactaaaaagctggaaaacccctaagtaaatgcaatatcgatagaaagcgagtttcttgaagagtcatctgctaaactccactagagtcatctctacaataacaatatcaactgaatataaaatattaatgccatggatgatctcagaaatgatttcctacaaagtcccaacctatcctggaacatttcttatgtgtgcttgggagattgcaagaggacaactcggctctaaaatcgatgcattaacatgtcattggaattgaccttgccaaaagatgcctccctaaatccacaagaatctccttgtttgaacacagtttctaatccagctgtaatgaagacagacaacagtcaaattaacaactgatcaggaggagaagttcatactccttgagctggatctatctgcacatgcacctggcccaggaagctgaaatgggagatctgatgagcagtggaggactgaaccaaagcccttggcttttgctccataccagtcagagtctcatcaggatatcatgttgcattgagtagtcatgtctccacaggcttttcttggctgcgactcttactcacgttttccttggttttgcccaccttacagtttacagtagtggtcagccgttctggacatacacatgggcagaagatgtagccgccttgtgtgaaaatttgagagctctctactccatcttccgctagtataaccctcattggctggaatcataatggtatctgcatctggaactggccactagtataacacctacaaaatgcacaacggccttcagaccatatgaaaagtctacagggtgagaatctgaaaatccagcaatgaggagaaaaaagttatctcccattaagaacactttccagaagctacacaattccagttattgattcatcccatttactagaacctgttcatctggctatgcccaaaaccaagggaaactgaaatagtggttaccatattctgtaactcagcctagcctagcttcagaagttttaataaagaaaataaaat

SEQ ID NO: 734449 - DNA, 951 bp, Homo sapiens
agcttggcacgagggagggaatgtttgtgaatacatctggtgtgtactaaaaagctggaaaacccctaagtaaatgcaatatcgatagaaagcgagtttcttgaagagtcatctgctaaactccactagagtcatctctacaataacaatatcaactgaatataaaatattaatgccatggatgatctcagaaatgatttcctacaaagtcccaacctatcctggaacatttcttatgtgtgcttgggagattgcaagaggacaactcggctctaaaatcgatgcattaacatgtcattggaattgaccttgccaaaagatgcctccctaaatccacaagaatctccttgtttgaacacagtttctaatccagctgtaatgaagacagacaacagtcaaattaacaactgatcaggaggagaagttcatactccttgagctggatctatctgcacatgcacctggcccaggaagctgaaatgggagatctgatgagcagtggaggactgaaccaaagcccttggcttttgctccataccagtcagccgttctggacatacacatgggcagaagatgtagccgccttgtgtgaaaatttgagagctctctactccatcttccgctagtataaccctcattggctggaatcataatggtatctgcatctggaactggccactagtataacacctacaaaatgcacaacggccttcagaccatatgaaaagtctacagggtgagaatctgaaaatccagcaatgaggagaaaaaagttatctcccattaagaacactttccagaagctacacaattccagttattgattcatcccatttactagaacctgttcatctggctatgcccaaaaccaagggaaactgaaatagtggttaccatattctgtaactcagcctagcctagcttcagaagttttaataaagaaaataaaat

SEQ ID NO: 734450 - DNA, 404 bp, Homo sapiens
cgcaaagctcattaagaggcaacatggcggaatttacctggtgcatgacgttcctctaggaatgctagacttcatagctgctggaagaatcgcacgccttctgcggggtggctactcggaggaatatctgctgcctccaggaatgcctccgggtcttcacaggagtcccaccagaatcaccaagatggtttgctttggattcaaagtccctttttgtgttcataaaatcagaggtgttattttcatctacaggagccagaaattttagaaaatttggcacagaggaagaagaatgaagttttttccgcagggcattacggcaggagatgctctttggcacagcattcccactttgtcctccactggaattatgttttagggacttaaaaaagtttggcgaggag

SEQ ID NO: 734451 - DNA, 400 bp, Homo sapiens
gggcccatcttcacaaactggttctaaaggagatcgtgggggaagctctcccagctctgaataatcttcatagctgctggaagaatcgcacgccttctgcggggtggctactcggaggaatatctgctgcctccaggaatgcctccgggtcttcacaggagtcccaccagaatcaccaagatggtttgctttggattcaaagtccctttttgtgttcataaaatcagaggtgttattttcatctacaggagccagaaattttagaaaatttggcacagaggaagaagaatgaagttttttccgcagggcattacggcaggagatgctctttggcacagcattcccactttgtcctccactggaattatgttttagggacttaaaaaagtttggcgaggag

SEQ ID NO: 734452 - DNA, 1637 bp, Homo sapiens; identical to SEQ ID NO: 43456

SEQ ID NO: 734453 - DNA, 460 bp, Homo sapiens; identical to SEQ ID NO: 728870

SEQ ID NO: 734454 - DNA, 1333 bp, Homo sapiens
atgacctgtagcccatgtgtatacaaccctttcctgcacgtctgcacacggagtgaacagaacccagccagcacgggtgaggaccagatgagagatgggggctgcagcagcaaagtctgggacggaggtctcagagagccccttggggtggcgaaggccctccacacatcagagctccagaccctgaagaagagggcagagctacatggtgctgccaggtgagtcctgcaccgccaggcctcctgtgggaggggcaggaatggccaacggacctcatctccatccgagcctgtctgaggcaggacagctgggtgtgtctgagaagcaatgtcatgctagtactcagcccctgtgccaatattacattctagttctggggcaattcatcaggagcagaagggctgggaaagagcaggccactccccaggcctgttctcacacctgcctgcagaatcacaggtaggtttcaggctccatctaggataccctagaaggcggggctattctaggtagcaaaagcctctgcctctgattctcacccacatgcagaagcagtcacaacttgcacacaacacagctcacaactagggaaagcacttgttaaagagaatgcccccagggcatggccagcatgccgatacagtgttcccatgcccctgttactgatcctgtcctcctgccttctagaacagtggacctcacatcacctcccagattgtctccattttatggattgaaactctgaggcctccagacatgaagaagcagccatagattcagtcaaatgccagccaagggtttgccttgcctcagacaacctccccagccccatttgacccagagaccagctgtcagggagcgacctcagagccagaggggtgaaagatgagaggcaagaaggtagctcctatcctagcacagcccaggctccatctgtctgcctttctctcccctgcggcatcctggcagggcagttggcagagtgccccctccccaggaggctgcagatctctgtccctggctcacccagatcggtctgttctctgcagttccattcctttagcctctttcgcaggtctgagcatctctggagcatgcaggggaggagatatctgaggtgggcttccgtgcagtcagcagcctgccccagcttcagcctcaggcgtcaggctggtctgcactgaactctgggtctgcctctggggccctgaccaagcacgcctgactccagccccatgaggagcatcctgtcttggttccgtagggatcatgggtcctcttaccactgtgcgccaagcccccagcccacctctgcctgggccgacttcctggt

SEQ ID NO: 734455 - DNA, 1316 bp, Homo sapiens
ggggaaaggaggtacacacagtcgcgcgcgcacggacacacacacacacgcacgcacgcacacacaccggtggcgagttcgagccccgcggcccctgtccgcccgcgtgcgcccctcgacacagctcgcctcccgccccctgattcctgctgctgccgcccagaggagaaaggaacctttgcctcgaatttccccactgcgccgggcgctgcggagagcggcgagggtgggcgcgaggcggagaacgcgatgaatgagttctcccctcgcctcggagttgtctgagttggcggcgctgcgcccaggcttccggctctcagcgccccacgcgcgcgtggctccccgggctgccacccacgcccgcggccggggccgagccagccacgcagggcagccgaggctccggagctcctgtcccggccccagtccgggtaaaaggagggttgtccccagcggaggcgcacagccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagctttaaagatgggagccttaagaacaaaggattaaaacagcagcaacagcaacataagaaactcctggccgcaatgctctctcaagattcttttgagtccatccacagccctaccccatctgtaa

SEQ ID NO: 734456 - DNA, 951 bp, Homo sapiens
acttcggagagagaatgtagaatggaggaggtgaggaatttaactaatagagatgctttttctaacaggcagaaattagagaaatggatcaaaagatttaaacattgattacatataaacgagtttcctttttttctacatagcacacaggtgctcaacatttaatgaataatataacagatactgtcttaaaagtttaaaaacaggatttgtacttaatcctaaattcctcttatcacacaccagaaaataatttggattttatttacaaactacatccaaatactcttaaggaaagagtgtcatttagcttggagtagggactgactggggtctaagtgttggaaattaaattctgccattcagtccaacctcaaaggtgttccaggcaaggagttttgcaaggactagaaaccctttcacacttgaagtgcaggtgttggctgaaagaatagagggacatttcacaaacacagaacacggctcccctacaggaaagggatggagacagctacctttgctcttgctctcacattctctgtcctcatggactttcttctctgtttccctctgcctatctatctgcctggttctcttgcttctcctggccaaccagctttctcattagtgcatatgtagctgaaaaatccacccctcaagaacccactccacacaacctttccttttcagtacccaccacgctctgactagcatctctgtgatgcctaaggcaaatttttgaggatctgattggtttagttcatctgcctatgggtgagccaccctggggtcaggtgcctgtccaatcacctgttaccaaggaggcagggccgtgtcatttaagcatggccccatggactgaccctttcagcagggacttttattgggggctggtacccagaagaaggagcatgagtgggcaagaccttcaaaaagaacctactacacact

SEQ ID NO: 734457 - DNA, 499 bp, Homo sapiens
catctatcagatgggaatagtaatactcattttacctatttttaccaggtggttgtaggaacaggattcattcattccttcattaatataatgaacactttgagaccccactatataacagggccatacatatgacaaggtgatagatggaaagacgttttgcagaatttttgaagacttgcaatgtttttgaagactacaggatagtttgtgatttttatattaaggtcgtatcaactctttatgtcaatatatcaaagtaattgacacttttagagctctgccaatcagtgggccatattcatagaatgtcagtaatctgtctgaatacaagttatagttggtctttagctgttctgtctctgaggagctagaaataaaatattaggttctaatttttttttgttcaaacactgatcatgtaacaaactgcaaatccatgttttcagcaggttcgccaacctttgagttgaatgcagacctttctttagaacaacct

SEQ ID NO: 734458 - DNA, 470 bp, Homo sapiens; identical to SEQ ID NO: 728882

SEQ ID NO: 734459 - DNA, 2040 bp, Homo sapiens
ctgaagactggctagtcctggcagaacagtactttggagttccctggagcctggccagccctcacctcttctggatagaggattcccccaactccccaactttctccatgagggtcacgccccctgaggacctcaggaggccagcagaacccgcaggctcctgaagactggctacgcctcctgagaccacttggaaacagaccaactgcccccgtggttgcctggtggctggacccccgggattgactagagaccggccgtacaccttctgcatctcactggagactgaacactagtcccttgcggtcacgtgggacactgggcgcctcctcctccccctcctcctcacctggagagactacaggaacttcagggtcactccccgtggtcacatggaggttgtgggccgaggcgcttattttcccttatggtgacctgagtcctggagactcccattctccccctctccctgagagtcccctgcagtttctgggtaacagggcacacccctctagtttcatgggcgagcacccccatctgccacctcagactgacacacagccagctggctcacttactgggggccacgtcccacccctcagatatttctttgaagggagagcaaacccaccctgtcctctgacgtccctttcccaactgtcaccaaacagaccatcttcccaggcctggggaccggtaagatccatgtcactagttatgcagagcagttgccttgggtcccactgtcaccaaggcaaccagtcctgctgctacctgtcacctagagtcacacaccccttccctcatcaggcacacccatgaagacagtgcctccctcctccagctgtaaccatggataccacacatttctcatctcattggcccccaccccagagacctccacctcaacttctggctgtccctaccctgactcaccgccatggagatcaccctccccgaagctgtcgccagggtgacccaacatccagttctccggctctcaccatggaaacaaactgtccctgtccccaggcccactccagttccagaccaccctccatgctccacccccaggcggtttggaccccaccactgttgccatggtgaccaaactctggagtccgaggtaacagaacacctgtccccctaggcttttccttgtggacaacggggccctgttcaccaagctgttcccatagagactgtcaacgttgtcctcatgacaaccagacttccagttctcaggaacttctcattgtgggccagaagtcctgggtgcctcctactagggctaccctactgcaccccatcaggggcctgatggctgccccttccccagacagggctggacttctggagctgctaagccaccctccgtttgcacgttaactctatgccggatagcagctgtgcacgagacaatcttgcaacacccgggcatgtttgtcgtcgtcctacaaatgaggaaaccgagcctatggcgtgccctggtctgttgagatatgcaagcactgagctcctcttttgtcctctgagaccccatctccattctcacccagttcctctctccttccctgacccccacccacatttccctccttagagatccaggagggatggaatgttctttaaaattcaacacccaccaggctctaagcggcgatctgtgctaagaggtcaggacccagccgaagtcctcggcgttgacaggcagctggggggacatgatccatggacaaggccatcccggccgtgggagaccccagtcccgaagtcttgcctgcaggagtactggggtccccctggggccctctttactgtcacgtcatctctaggaaacctatctctgagttttgggaccaggtcggtttgggtttgaattctgcctcttcttgctcactgtgtgaccaagtgacaaactccttctgaacctgtgttctcccactgtaccagggctgttctgtggtccccgtgagtgccaagcatacagtaggggctcaataaatccttgtttcttttgatgaatgagaaaatgaggca

SEQ ID NO: 734460 - DNA, 1680 bp, Homo sapiens
ctgaagactggctagtcctggcagaacagtactttggagttccctggagcctggccagccctcacctcttctggatagaggattcccccaactccccaactttctccatgagggtcacgccccctgaggacctcaggaggccagcagaacccgcaggctcctgaagactggctacgcctcctgagaccacttggaaacagaccaactgcccccgtggttgcctggtggctggacccccgggattgactagagaccggccgtacaccttctgcatctcactggagactgaacactagtcccttgcggtcacgtgggacactgggcgcctcctcctccccctcctcctcacctggagagactacaggaacttcagggtcactccccgtggtcacatggaggttgtgggccgaggcgcttattttcccttatggtgacctgagtcctggagactcccattctccccctctccctgagagtcccctgcagtttctgggtaacagggcacacccctctagtttcatgggcgagcacccccatctgccacctcagactgacacacagccagctggctcacttactgggggccacgtcccacccctcagatatttctttgaagggagagcaaacccaccctgtcctctgacgtccctttcccaactgtcaccaaacaaggcccactccagttccagaccaccctccatgctccacccccaggcggtttggaccccaccactgttgccatggtgaccaaactctggagtccgaggtaacagaacacctgtccccctaggcttttccttgtggacaacggggccctgttcaccaagctgttcccatagagactgtcaacgttgtcctcatgacaaccagacttccagttctcaggaacttctcattgtgggccagaagtcctgggtgcctcctactagggctaccctactgcaccccatcaggggcctgatggctgccccttccccagacagggctggacttctggagctgctaagccaccctccgtttgcacgttaactctatgccggatagcagctgtgcacgagacaatcttgcaacacccgggcatgtttgtcgtcgtcctacaaatgaggaaaccgagcctatggcgtgccctggtctgttgagatatgcaagcactgagctcctcttttgtcctctgagaccccatctccattctcacccagttcctctctccttccctgacccccacccacatttccctccttagagatccaggagggatggaatgttctttaaaattcaacacccaccaggctctaagcggcgatctgtgctaagaggtcaggacccagccgaagtcctcggcgttgacaggcagctggggggacatgatccatggacaaggccatcccggccgtgggagaccccagtcccgaagtcttgcctgcaggagtactggggtccccctggggccctctttactgtcacgtcatctctaggaaacctatctctgagttttgggaccaggtcggtttgggtttgaattctgcctcttcttgctcactgtgtgaccaagtgacaaactccttctgaacctgtgttctcccactgtaccagggctgttctgtggtccccgtgagtgccaagcatacagtaggggctcaataaatccttgtttcttttgatgaatgagaaaatgaggca

SEQ ID NO: 734461 - DNA, 1400 bp, Homo sapiens
tcgaacctggcgccgttacttagggcacctctcttgtgccctgttggaccggggaaaacccagtggcgagctattttatgcagagcagttgccttgggtcccactgtcaccaaggcaaccagtcctgctgctacctgtcacctagagtcacacaccccttccctcatcaggcacacccatgaagacagtgcctccctcctccagctgtaaccatggataccacacatttctcatctcattggcccccaccccagagacctccacctcaacttctggctgtccctaccctgactcaccgccatggagatcaccctccccgaagctgtcgccagggtgacccaacatccagttctccggctctcaccatggaaacaaactgtccctgtccccaggcccactccagttccagaccaccctccatgctccacccccaggcggtttggaccccaccactgttgccatggtgaccaaactctggagtccgaggtaacagaacacctgtccccctaggcttttccttgtggacaacggggccctgttcaccaagctgttcccatagagactgtcaacgttgtcctcatgacaaccagacttccagttctcaggaacttctcattgtgggccagaagtcctgggtgcctcctactagggctaccctactgcaccccatcaggggcctgatggctgccccttccccagacagggctggacttctggagctgctaagccaccctccgtttgcacgttaactctatgccggatagcagctgtgcacgagacaatcttgcaacacccgggcatgtttgtcgtcgtcctacaaatgaggaaaccgagcctatggcgtgccctggtctgttgagatatgcaagcactgagctcctcttttgtcctctgagaccccatctccattctcacccagttcctctctccttccctgacccccacccacatttccctccttagagatccaggagggatggaatgttctttaaaattcaacacccaccaggctctaagcggcgatctgtgctaagaggtcaggacccagccgaagtcctcggcgttgacaggcagctggggggacatgatccatggacaaggccatcccggccgtgggagaccccagtcccgaagtcttgcctgcaggagtactggggtccccctggggccctctttactgtcacgtcatctctaggaaacctatctctgagttttgggaccaggtcggtttgggtttgaattctgcctcttcttgctcactgtgtgaccaagtgacaaactccttctgaacctgtgttctcccactgtaccagggctgttctgtggtccccgtgagtgccaagcatacagtaggggctcaataaatccttgtttcttttgatgaatgagaaaatgaggca

SEQ ID NO: 734462 - DNA, 721 bp, Homo sapiens
  misc_feature (577)..(577): n is a, c, g, or t
  misc_feature (581)..(581): n is a, c, g, or t
  misc_feature (599)..(599): n is a, c, g, or t
  misc_feature (619)..(619): n is a, c, g, or t
  misc_feature (628)..(628): n is a, c, g, or t
  misc_feature (650)..(650): n is a, c, g, or t
  misc_feature (657)..(657): n is a, c, g, or t
gcagctgagtcagtgagcagcgccatgatgaggggcagtccctgccagcaccaacaggggctggaaacccagcgataggagcatcagcatctccgaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgacctttcatagaccctgaggccatcaagtacttccgggagaggatggagaagagggacgggagcgaggaggacttcacttagactgcngcangagagataccctgccganaccagccacacatggcggantcctggccnggagctcgacaggaagcaccanagctgancgacgagtgctgggtctggggcactggggtgacaaaacctcaagctggccgggaacctcagcac

SEQ ID NO: 734463 - DNA, 1160 bp, Homo sapiens
  misc_feature (1016)..(1016): n is a, c, g, or t
  misc_feature (1020)..(1020): n is a, c, g, or t
  misc_feature (1038)..(1038): n is a, c, g, or t
  misc_feature (1058)..(1058): n is a, c, g, or t
  misc_feature (1067)..(1067): n is a, c, g, or t
  misc_feature (1089)..(1089): n is a, c, g, or t
  misc_feature (1096)..(1096): n is a, c, g, or t
gcggccgctgacgcggggcgccagctgccaacttcgcgcgcggagctccccggcggtgcagtcccgtcccggcggcgcgggcggcatgaagactagccgccgcggccgagcgctcctggccgtggccctgaacctgctggcgctgctgttcgccaccaccgctttcctcaccacgcactggtgccagggcacgcagcgggtccccaagccgggctgcggccagggcgggcgcgccaactgccccaactcgggcgccaacgccacggccaacggcaccgccgcccccgccgccgccgccgccgccgccaccgcctcggggaacggcccccctggcggcgcgctctacagctgggagaccggcgacgaccgcttcctcttcaggaatttccacaccggcatctggtactcgtgcgaggaggagctcagcgggcttggtgaaaaatgtcgcagcttcattgacctggccccggcatcggagaaaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgacctttcatagaccctgaggccatcaagtacttccgggagaggggcaaatcgaggcacagagagggagggcgacttgcccccaggtcacacagctggatggagaagagggacgggagcgaggaggacttcacttagactgcngcangagagataccctgccganaccagccacacatggcggantcctggccnggagctcgacaggaagcaccanagctgancgacgagtgctgggtctggggcactggggtgacaaaacctcaagctggccgggaacctcagcac

SEQ ID NO: 734464 - DNA, 1106 bp, Homo sapiens
  misc_feature (962)..(962): n is a, c, g, or t
  misc_feature (966)..(966): n is a, c, g, or t
  misc_feature (984)..(984): n is a, c, g, or t
  misc_feature (1004)..(1004): n is a, c, g, or t
  misc_feature (1013)..(1013): n is a, c, g, or t
  misc_feature (1035)..(1035): n is a, c, g, or t
  misc_feature (1042)..(1042): n is a, c, g, or t
gcggccgctgacgcggggcgccagctgccaacttcgcgcgcggagctccccggcggtgcagtcccgtcccggcggcgcgggcggcatgaagactagccgccgcggccgagcgctcctggccgtggccctgaacctgctggcgctgctgttcgccaccaccgctttcctcaccacgcactggtgccagggcacgcagcgggtccccaagccgggctgcggccagggcgggcgcgccaactgccccaactcgggcgccaacgccacggccaacggcaccgccgcccccgccgccgccgccgccgccgccaccgcctcggggaacggcccccctggcggcgcgctctacagctgggagaccggcgacgaccgcttcctcttcaggaatttccacaccggcatctggtactcgtgcgaggaggagctcagcgggcttggtgaaaaatgtcgcagcttcattgacctggccccggcatcggagaaaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgacctttcatagaccctgaggccatcaagtacttccgggagaggatggagaagagggacgggagcgaggaggacttcacttagactgcngcangagagataccctgccganaccagccacacatggcggantcctggccnggagctcgacaggaagcaccanagctgancgacgagtgctgggtctggggcactggggtgacaaaacctcaagctggccgggaacctcagcac

SEQ ID NO: 734465 - DNA, 983 bp, Homo sapiens
gcagccttgacctcccgggcccaggtagtcctcccacctcagcctcccatgtagcaggaaccacaggcaggcaccaccatacccagctaatttttgtattttttgtagagatggggtttcgccatgttgcccaggctagtcttttctttcttctctttttttttccccacagtatatattatacagcagtcataatatctataaatacatagagtttatgttgtgaagtttcccagttcactgaaatgttaggtttcctaaagggtacagtgccgtataaaacaacctgcctcatatatttctcctcaaaacgttggactatttgggaaaaggaaaagagttgggaaaattggttttaaggtaagttttagtcaaaagaattctttcttgaaactagctggtttgtggattcagatactctgatccttacagaatccaagaggaagctttcataaaaacaattcagcaaatatttccaatataatttgaatggctaattttcagttgctaattaattagcagctttgtaatacttgatttgggagcatttacttggaaatcctaaggactataataaaagttttcaacatatttctaaattgtgtgagtttccagctgtagcttttgtctttgtcacattttaaaaaataataagcaagacacattggggacactggcagcagttgccaggttttagctgccaccgcttcagtatgagatatagctgtcccatcttcccccattcagggtaggagatatagtgacccagacttcatgcaaatggaaaaaaagttttaactgaaatatttatttagatttcagggtctagatggatgggaaagtagaaaaacatatggcaaatcttcagtgttctcactatgaccactcttgagcagagatttggttttgtttccttttgtaacaaagtgaaaacaggtgagacaatgtgcccaaaacaaagggaagaagagaaccttctgtga

SEQ ID NO: 734466 - DNA, 491 bp, Homo sapiens
catgagggagacaggcaaacctgtgtgggttgggggtgtcttcctatgtaatagaaggtctcgtggtggggcatgctgtctttcgtttgaggggatgatgggcctccagttggtggcgaatcttttgaaacttgtttttagcattcccaaatttttttagagaaaaattcagaaagtacaggtgcctttggcgtttcatagtcaatatacaagcgagacacaagtattctccatggatgatttttgtgttgtcatggaatgaaagaaaaataccagtgggtctttactggccataatattttcgttttctcagttggcacatagctctttcgtcgcggaattcacttctttccatcccctctctctacttttaaatattttatgggcagtaagctcacaatatgtgctagcacggctgctctctccagaggtcaggatgggtttaataatgagatgcgtaacagtgactctgtaaaaacccatttcaggtt

SEQ ID NO: 734467 - DNA, 486 bp, Homo sapiens
gtggaatcctaatagttttttccgtaatctccaactatatttaaaataatgcccttctaaatagctctgtaaagagcctattggaagctgcacatttaaaaatggcaatagcactgcaatatgctgtagcatgatgcctgtcagccatgttccagacaattccttgtaagtcatctttcatttaagtaaaaaacaggttatgaagtactgcctcccagaccggaagtgccattctaaaaactccactatatatatcctgggagccataaaactgcctattgggaggctaaatgctctgcttttctataaaacagagataaggttctagagggaagtactgttaccagaaacaagggcacgtttcttctctgcctaggaatgcttcatctgggggacagaggggaaggtttcaatggaaaagggaacttattatttaaccaggtccctactacatggtggccaacccttttcaaatgactcctctca

SEQ ID NO: 734468 - DNA, 455 bp, Homo sapiens; identical to SEQ ID NO: 728887

SEQ ID NO: 734469 - DNA, 623 bp, Homo sapiens
atgttcttttatggaacaaatcagattaatactaatgttaaggagagctttaaaggagaaagagaatcaataaatcacagcctgaaagttgtgtatgttgtgtgcaagctcagaggggcagtcttcttcaatttgccttgtgctggtgaattgcttgaatgaacttcggtatttcttaacaccaggtactggagcccaccttctttctctccctctggtttcctctttaaatcacagcctgaccccagtctttatagtccattgtaagtggaagttatagctctattcttcacccacaccttgctccctatcattgatacttagaagaaagtaacaatttgcagtactggctgaactcctttgggaaagtttctggagtgtatcaaataagaattcatcatagtaacatggtcgttactggctgaacaaaattctttttgagactattgtacttagtcattaaataattgtttactaaggcaattttcatgtttctggaattcagtgtaatagttaacagctgtatatgtctcacaaaaggaaactacttaggttggaaacaatggaaggttgtgtataattaattcaatcaggtcatgaatatttatgtaacatatggcatt

SEQ ID NO: 734470 - DNA, 569 bp, Homo sapiens
atgttcttttatggaacaaatcagattaatactaatgttaaggagagctttaaaggagaaagagaatcaataaatcacagcctgaaagttgtgtatgttgtgtgcaagctcagaggggcagtcttcttcaatttgccttgtgctggtgaattgcttgaatgaacttcggtatttcttaacaccaggtactggagcccaccttctttctctccctctggtttcctctttaaatcacagcctgaccccagtctttatagtccattgtaagtggaagttatagctctattcttcacccacaccttgctccctatcattgatacttagaagaaagtaacaatttgcagtactggctgaactcctttgggaaagtttctggagtgtatcaaataagaattcatcatagtaacatggtcgttactggctgaacaattttcatgtttctggaattcagtgtaatagttaacagctgtatatgtctcacaaaaggaaactacttaggttggaaacaatggaaggttgtgtataattaattcaatcaggtcatgaatatttatgtaacatatggcatt

SEQ ID NO: 734471 - DNA, 592 bp, Homo sapiens
caatgtaagtcagattatgttgctcctctgcttggaaccttccaatgactccctctgaactctttttctcagagtaaaagctcccgtctttccaagtcctatgcagaaatcttgtattgtctggatctgctcctgttacctctctgacgacactctcccatgctcactctgctccagccacactggcctcgctcttcctttagcataccacatgtgctttgccttggtggcttcttctgcctgtactgctcttcctccagatattcaaatggcttactctttgacctcctttgagtgtttgttcaaatgcctctatctcaattaggccactttgatcacccatttaattacaacccacacctcacaggtaatccccagccctcttaccctgttttcttcatagcactcatactgtactatactatgtaatttacctatttattatgcttcctatcaagtttctttctcctaggatgtaagctaatgaaagcagagattattgtctcatttcctggtgtacccccagcacctagaacactgtttggcacatggtagaggctcaataaacatttgttgggcgaatacatgaacg

SEQ ID NO: 734472 - DNA, 451 bp, Homo sapiens; identical to SEQ ID NO: 728888

SEQ ID NO: 734473 - DNA, 693 bp, Homo sapiens
agggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaaggtgggcaaactgcgcgagcggctgcaggaggcgaagctggagcgcgagcaggagcagcgacggcacacggcctacatttcggagctcaaggccaagctgcatgaggagaa

SEQ ID NO: 734474 - DNA, 2069 bp, Homo sapiens
agggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaagatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagtaagagactctatctgttgtaaactctcaaacggagcagacattctctttgaacccaaactgaaattcatgtaaagctctcagatgttttcaagcatgtgtaaaggggacatgttatagtttctttctttctttctttctttttttttttaaatctgtatgttcagaataatttcactgccttaatgtgttctggagagcgtgctcacccaagtctatggacatgtaccagagctaatatatttattgcctatggcttgttttgcacttaataaaataatttgtttttgcaataaaaaaaatt

SEQ ID NO: 734475 - DNA, 1631 bp, Homo sapiens
agggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaagatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagaatgaaatgcaagacgccaaggatcagaacgagctgttagaattcagagtgctagaactcgaagtaagagactctatctgttgtaaactctcaaacggagcagacattctctttgaacccaaactgaaattcatgtaaagctctcagatgttttcaagcatgtgtaaaggggacatgttatagtttctttctttctttctttctttttttttttaaatctgtatgttcagaataatttcactgccttaatgtgttctggagagcgtgctcacccaagtctatggacatgtaccagagctaatatatttattgcctatggcttgttttgcacttaataaaataatttgtttttgcaataaaaaaaatt

SEQ ID NO: 734476 - DNA, 397 bp, Homo sapiens
  misc_feature (46)..(46): n is a, c, g, or t
  misc_feature (379)..(379): n is a, c, g, or t
aagacagccaagcagtgcaccatggagatggccaccggggaggtgnacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtgggcacacgtatcgctggctgctcctcaaactgttgctgctcctgctgcttgttcctccttcttgccctgttcctctnatttgttgcctgggttac

SEQ ID NO: 734477 - DNA, 510 bp, Homo sapiens; identical to SEQ ID NO: 506278
  misc_feature (459)..(459): n is a, c, g, or t
  misc_feature (469)..(469): n is a, c, g, or t
  misc_feature (495)..(495): n is a, c, g, or t

SEQ ID NO: 734478 - DNA, 468 bp, Homo sapiens; identical to SEQ ID NO: 506280
  misc_feature (337)..(337): n is a, c, g, or t
  misc_feature (453)..(453): n is a, c, g, or t
  misc_feature (458)..(458): n is a, c, g, or t

SEQ ID NO: 734479 - DNA, 2186 bp, Homo sapiens; identical to SEQ ID NO: 348995

SEQ ID NO: 734480 - DNA, 824 bp, Homo sapiens; identical to SEQ ID NO: 349001

SEQ ID NO: 734481 - DNA, 2387 bp, Homo sapiens
  misc_feature (2364)..(2364): n is a, c, g, or t
  misc_feature (2368)..(2368): n is a, c, g, or t
  misc_feature (2370)..(2371): n is a, c, g, or t
  misc_feature (2375)..(2376): n is a, c, g, or t
  misc_feature (2381)..(2383): n is a, c, g, or t
  misc_feature (2385)..(2385): n is a, c, g, or t
  misc_feature (2387)..(2387): n is a, c, g, or t
gatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagactacacaggttgttatgtttggtcaacatgaagcgtttcccagaacttctctgacccaagaatggtgaagtggtggtacagtggcagaggcagcctcgtgggctctcttgctggggctctggcagctcacagcacatctgcccagattctgaggttctgcactgtggggctgggagggccaagtaggggcctcattcctcactctagctgccaccctgcaccgtccttacggcaatatgcttttgtagcatgtttgactttccaaaacgtttccagcatctttcagatttccccaaccagcccttggggcagtggccctgtgcaaaccttggctcaggaaggagattgggctcgctccacacaccctgtcggcgacgntgcngnncagnncgagnnncngn

SEQ ID NO: 734482 - DNA, 1742 bp, Homo sapiens
gatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacactgacccagacccacttcctccagagaggcctctctccgcctgagctatttcccttgctagtgtgcagatatttccctaacatgtccttttttgtatttgtttgtacggaccataaatataactgtagctttaagacta

SEQ ID NO: 734483 - DNA, 2584 bp, Homo sapiens; identical to SEQ ID NO: 349003
  misc_feature (2561)..(2561): n is a, c, g, or t
  misc_feature (2565)..(2565): n is a, c, g, or t
  misc_feature (2567)..(2568): n is a, c, g, or t
  misc_feature (2572)..(2573): n is a, c, g, or t
  misc_feature (2578)..(2580): n is a, c, g, or t
  misc_feature (2582)..(2582): n is a, c, g, or t
  misc_feature (2584)..(2584): n is a, c, g, or t

SEQ ID NO: 734484 - DNA, 1939 bp, Homo sapiens; identical to SEQ ID NO: 348997

SEQ ID NO: 734485 - DNA, 2195 bp, Homo sapiens
aggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagaggatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagacta

SEQ ID NO: 734486 - DNA, 2757 bp, Homo sapiens
  misc_feature (2734)..(2734): n is a, c, g, or t
  misc_feature (2738)..(2738): n is a, c, g, or t
  misc_feature (2740)..(2741): n is a, c, g, or t
  misc_feature (2745)..(2746): n is a, c, g, or t
  misc_feature (2751)..(2753): n is a, c, g, or t
  misc_feature (2755)..(2755): n is a, c, g, or t
  misc_feature (2757)..(2757): n is a, c, g, or t
aggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagagctctccgccctcaccgtggttttagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagactacacaggttgttatgtttggtcaacatgaagcgtttcccagaacttctctgacccaagaatggtgaagtggtggtacagtggcagaggcagcctcgtgggctctcttgctggggctctggcagctcacagcacatctgcccagattctgaggttctgcactgtggggctgggagggccaagtaggggcctcattcctcactctagctgccaccctgcaccgtccttacggcaatatgcttttgtagcatgtttgactttccaaaacgtttccagcatctttcagatttccccaaccagcccttggggcagtggccctgtgcaaaccttggctcaggaaggagattgggctcgctccacacaccctgtcggcgacgntgcngnncagnncgagnnncngn

SEQ ID NO: 734487 - DNA, 997 bp, Homo sapiens
aggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagagctctccgccctcaccgtggttttagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcctctctccgcctgagctatttcccttgctagtgtgcagatatttccctaacatgtccttttttgtatttgtttgtacggaccataaatataactgtagctttaagacta

SEQ ID NO: 734488 - DNA, 2112 bp, Homo sapiens
aggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagagctctccgccctcaccgtggttttagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacactgacccagacccacttcctccagagaggcctctctccgcctgagctatttcccttgctagtgtgcagatatttccctaacatgtccttttttgtatttgtttgtacggaccataaatataactgtagctttaagacta

SEQ ID NO: 734489 - DNA, 2359 bp, Homo sapiens
aggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagagctctccgccctcaccgtggttttagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagacta

SEQ ID NO: 734490 - DNA, 2500 bp, Homo sapiens
gatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagactacacaggttgttatgtttggtcaacatgaagcgtttcccagaacttctctgacccaagaatggtgaagtggtggtacagtggcagaggcagcctcgtgggctctcttgctggggctctggcagctcacagcacatctgcccagattctgaggttctgcactgtggggctgggagggccaagtaggggcctcattcctcactctagctgccacccctgttggtccggagaacaggctgggggcgaggcggttttaagccaggagggatgagatccagtctgaagtgtagtgtcacttggtcctatttcgtataccttctctgtgggagtatccagctctctcagaggccatgaagacccgggtataggagacagaaggaagggaacgcaggaagggcctgggcacggggaagtgggaagagctcagggctgcggccagcaggagccagtgtgcacaccctccaggcggcagctgccagcgagggcccctgtgctggccacaagcggggccaaa

SEQ ID NO: 734491 - DNA, 1460 bp, Homo sapiens
tccagacacatgtgccatttagggctctaggattctgtctgcaagggcagccatgagggccgggcacggagccccagacgactccccatggagagacagggagcagaaccacaggaactcagggtcccgggtgccagaaggggggcgtttctgcacctcagcagctgtggtgagggctgctgaggggtcaagaggaggtgtgggtccctgggcagatgaggccagggtagcacacgcgaggggcagcgggtgtgctgggagaagccggggaggaaggcccagcagtgtttttaacccagctccccagcccagtccttcagaaaggacgagagatgggtagcacacaggaggggtggcaggtgtgccgggaagggctgtggcccagtcctctctggcccaacacggccacctcacctgccggcattcttcacaaagcccaggtcagccagctccacatcacacagctcgcagcggaagcagcccgggtgccagttgttgttcatggccttgatgacgcggccaatgatgaactcacctggaagaagacaggtccctgctggctggggagcacgtgcctgtcccctcttcggaccctcccaagccctgtccacctagcactccgcctgctctctgcctggcccatgggctccctcgtgggatggtgatgcctgtagggggcctgacggctgccgctcagagaggcaaggtggggagttaggaaagagctgggccagttctgtgtaccccctcggccccctgccccccgccactgctgcccacttcccaggcagcccaggatgtgtactgtcaccggccttaccgcaggatccacagcacggagcaaacagcatttggaagtcgtgttcgcagtacttccggccttcaaactgcaaaggggtcgcagagagaggacaagcaaaccacctatcatccccatgagcagcccaggcccttgttgggtcaggacctgacagcaggggatgaggcactgaggcaggggcatgccgggctgaggctggagcagtgggtcccaggcctggccagagaggacactggcccttttgggatggtggggtgcaaagggaggtgcccccgtggaagctggagaggtccgtgaggccacctgtcaaagggccactggtgtctactgaggatctggaccctgttggtccggagaacaggctgggggcgaggcggttttaagccaggagggatgagatccagtctgaagtgtagtgtcacttggtcctatttcgtataccttctctgtgggagtatccagctctctcagaggccatgaagacccgggtataggagacagaaggaagggaacgcaggaagggcctgggcacggggaagtgggaagagctcagggctgcggccagcaggagccagtgtgcacaccctccaggcggcagctgccagcgagggcccctgtgctggccacaagcggggccaaa

SEQ ID NO: 734492 - DNA, 2697 bp, Homo sapiens; identical to SEQ ID NO: 348996

SEQ ID NO: 734493 - DNA, 2870 bp, Homo sapiens
aggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagagctctccgccctcaccgtggttttagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagactacacaggttgttatgtttggtcaacatgaagcgtttcccagaacttctctgacccaagaatggtgaagtggtggtacagtggcagaggcagcctcgtgggctctcttgctggggctctggcagctcacagcacatctgcccagattctgaggttctgcactgtggggctgggagggccaagtaggggcctcattcctcactctagctgccacccctgttggtccggagaacaggctgggggcgaggcggttttaagccaggagggatgagatccagtctgaagtgtagtgtcacttggtcctatttcgtataccttctctgtgggagtatccagctctctcagaggccatgaagacccgggtataggagacagaaggaagggaacgcaggaagggcctgggcacggggaagtgggaagagctcagggctgcggccagcaggagccagtgtgcacaccctccaggcggcagctgccagcgagggcccctgtgctggccacaagcggggccaaa

SEQ ID NO: 734494 - DNA, 2732 bp, Homo sapiens
  misc_feature (2709)..(2709): n is a, c, g, or t
  misc_feature (2713)..(2713): n is a, c, g, or t
  misc_feature (2715)..(2716): n is a, c, g, or t
  misc_feature (2720)..(2721): n is a, c, g, or t
  misc_feature (2726)..(2728): n is a, c, g, or t
  misc_feature (2730)..(2730): n is a, c, g, or t
  misc_feature (2732)..(2732): n is a, c, g, or t
aggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagactacacaggttgttatgtttggtcaacatgaagcgtttcccagaacttctctgacccaagaatggtgaagtggtggtacagtggcagaggcagcctcgtgggctctcttgctggggctctggcagctcacagcacatctgcccagattctgaggttctgcactgtggggctgggagggccaagtaggggcctcattcctcactctagctgccaccctgcaccgtccttacggcaatatgcttttgtagcatgtttgactttccaaaacgtttccagcatctttcagatttccccaaccagcccttggggcagtggccctgtgcaaaccttggctcaggaaggagattgggctcgctccacacaccctgtcggcgacgntgcngnncagnncgagnnncngn

SEQ ID NO: 734495 - DNA, 972 bp, Homo sapiens
aggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcctctctccgcctgagctatttcccttgctagtgtgcagatatttccctaacatgtccttttttgtatttgtttgtacggaccataaatataactgtagctttaagacta

SEQ ID NO: 734496 - DNA, 2845 bp, Homo sapiens
aggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagactacacaggttgttatgtttggtcaacatgaagcgtttcccagaacttctctgacccaagaatggtgaagtggtggtacagtggcagaggcagcctcgtgggctctcttgctggggctctggcagctcacagcacatctgcccagattctgaggttctgcactgtggggctgggagggccaagtaggggcctcattcctcactctagctgccacccctgttggtccggagaacaggctgggggcgaggcggttttaagccaggagggatgagatccagtctgaagtgtagtgtcacttggtcctatttcgtataccttctctgtgggagtatccagctctctcagaggccatgaagacccgggtataggagacagaaggaagggaacgcaggaagggcctgggcacggggaagtgggaagagctcagggctgcggccagcaggagccagtgtgcacaccctccaggcggcagctgccagcgagggcccctgtgctggccacaagcggggccaaa

SEQ ID NO: 734497 - DNA, 2087 bp, Homo sapiens
aggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacactgacccagacccacttcctccagagaggcctctctccgcctgagctatttcccttgctagtgtgcagatatttccctaacatgtccttttttgtatttgtttgtacggaccataaatataactgtagctttaagacta

SEQ ID NO: 734498 - DNA, 2334 bp, Homo sapiens
aggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagacta

SEQ ID NO: 734499 - DNA, 2317 bp, Homo sapiens
ggccacgtgcctctctcacgggcagcacacggacaagagctcggtagtgtcggggaagcatctcggaggagctgcgggagggagcagagtgcccggacagagagagtgtggcaggggaagcatggctggggcctctgggggtcggcgctgcctctcactgatacaggggacgcatgcagaggcagccttggtggtcagtggaggagaatcccaaactgcttgtgcctcattgcgtttgggatgcctggtggacaccagagtggaggtgacatgtgggcagctgaggacagcgagagagaggcctgaagtggagcctggaattcctccagacacatgtgccatttagggctctaggattctgtctgcaagggcagccatgagggccgggcacggagccccagacgactccccatggagagacagggagaaaggtgactcagaggaggggagtgagcaggtgcagctgtgggggcgggcagaaccacaggaactcagggtcccgggtgccagaaggggggcgtttctgcacctcagcagctgtggtgagggctgctgaggggtcaagaggaggtgtgggtccctgggcagatgaggccagggtagcacacgcgaggggcagcgggtgtgctgggagaagccggggaggaaggcccagcagtgtttttaacccagctccccagcccagtccttcagaaaggacgagagagtggcgtggagaagcaagccctggagaaagtgtggggatgaacagggctcacagacagaggccgggctgcacgggatctcagagctagggccaggggaggtgggagacaaggccacctgctatagggacagtgcttgggaagggaggatgagagaccaagggttcgcagaaggtgggaacttctggagtacccatgaggtttgtggccctcaatttagagtaaatgtgggcatctccctccagccacactgagctgcacaggtacaggcaggagaaggtggacaggtggggtcagtagatggggtggccaggggggtggcagagtgtgaggatttctcatggctcccgagaggctgccaggagctcgctgagcgtggggccctgtaaactgggagctggactatccgccccggggtgacctggagggagggcagctacatcagtgcaggctgcagcaccgggacccttctgcgccctcagcaagtgggtagcacacaggaggggtggcaggtgtgccgggaagggctgtggcccagtcctctctggcccaacacggccacctcacctgccggcattcttcacaaagcccaggtcagccagctccacatcacacagctcgcagcggaagcagcccgggtgccagttgttgttcatggccttgatgacgcggccaatgatgaactcacctggaagaagacaggtccctgctggctggggagcacgtgcctgtcccctcttcggaccctcccaagccctgtccacctagcactccgcctgctctctgcctggcccatgggctccctcgtgggatggtgatgcctgtagggggcctgacggctgccgctcagagaggcaaggtggggagttaggaaagagctgggccagttctgtgtaccccctcggccccctgccccccgccactgctgcccacttcccaggcagcccaggatgtgtactgtcaccggccttaccgcaggatccacagcacggagcaaacagcatttggaagtcgtgttcgcagtacttccggccttcaaactgcaaaggggtcgcagagagaggacaagcaaaccacctatcatccccatgagcagcccaggcccttgttgggtcaggacctgacagcaggggatgaggcactgaggcaggggcatgccgggctgaggctggagcagtgggtcccaggcctggccagagaggacactggcccttttgggatggtggggtgcaaagggaggtgcccccgtggaagctggagaggtccgtgaggccacctgtcaaagggccactggtgtctactgaggatctggaccctgttggtccggagaacaggctgggggcgaggcggttttaagccaggagggatgagatccagtctgaagtgtagtgtcacttggtcctatttcgtataccttctctgtgggagtatccagctctctcagaggccatgaagacccgggtataggagacagaaggaagggaacgcaggaagggcctgggcacggggaagtgggaagagctcagggctgcggccagcaggagccagtgtgcacaccctccaggcggcagctgccagcgagggcccctgtgctggccacaagcggggccaaa

SEQ ID NO: 734500 - DNA, 1335 bp, Homo sapiens; identical to SEQ ID NO: 349006

SEQ ID NO: 734501 - DNA, 604 bp, Homo sapiens; identical to SEQ ID NO: 349002

SEQ ID NO: 734502 - DNA, 1523 bp, Homo sapiens
attgattggagagatgcctcaagaagatctgcacgcggtggtgaagaattgcttcgcggtggtgaatagctctgtctctgaaggcatgtcagctgcaattttggaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcagcccccgcccacctcttggctgaatttgagtggaaaaccagggaaggaacaagcgccacgtcacgcattagcctgcaaatcgcccgcgtgaccctgagatggaggcctgaggctttggggtccaggggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgc

SEQ ID NO: 734503 - DNA, 2035 bp, Homo sapiens; identical to SEQ ID NO: 422852

SEQ ID NO: 734504 - DNA, 524 bp, Homo sapiens; identical to SEQ ID NO: 728890

SEQ ID NO: 734505 - DNA, 1250 bp, Homo sapiens
caagttttattcacctcaaatcccactgggttcttaaaacttgaaaattcaaattgtagagaattatgagacacaatgtgatgtttagttaaagtcatgctatacctttctgggccacatattgctaactctgtggctaattatgcaattaattctcaacgtatcaaagcttttcactggcagtaaattctttgccctcaggtgaagtggattgaaaagacatcaaggatcaaggataatcactttgaatctgttggtttttccccctacattccagacactttaaatttggatgctttcattttttttaaatcaaaccacacaaatatgcagatactttcccagaatttcgcagttaaatggctgatcctcttgaaaactaaccttaatggaattctaaacatttcagtttagaatgactttgaaaaattccttagatttttaggatgttttattctgccaagtatgaaaaaaaaatggttaaatacaatggagttttaaaaattaacctggggattctatttgaactagaaaattcctattggaaaagaatttgcacatacttacagattcagctaataaattttaagaggattaggattctcataattctttaaatgaaaatttgttttagtgatacacagagatgccgtatactatagtgttatgttcagtaggaaaacttcaaatagttcgtatttaaaaaggtaattgatccttgctgtacttcccaacatctcatcttcttttagctgcagtaagatagaggtgactgtatggctacagttcatggtataaggtcatttagggtgcacactggcacacaggctggaaaacgggcactggacccagctttcaggtgtgtggtgctgggtaagtttcacctttgaagcctcagccttccatctgtaaagggcggtaatggtgcccacctttcgaggcattgcgaggctagatggtaacacacagaaagctcccacagtgggaccttgatgcagcgtagctggtattaacaaccgtggggacaccaggccactctttttctaccagttgttttatgaatccacctattaattttcatccatcttttggtcgtaggtaaaggtcaatcaggtttttcaaaaagactccctgtaataactttaagttcctgtatttctaagatatagggatttctacaaaacgactttgacatttagtcaataaagacttaaactcttcttaaatctatagttttaggagagtttttc

SEQ ID NO: 734506 - DNA, 938 bp, Homo sapiens
  misc_feature (886)..(886): n is a, c, g, or t
  misc_feature (895)..(895): n is a, c, g, or t
  misc_feature (898)..(898): n is a, c, g, or t
  misc_feature (902)..(902): n is a, c, g, or t
  misc_feature (917)..(917): n is a, c, g, or t
  misc_feature (924)..(924): n is a, c, g, or t
cagatagtaaagataagacttctggagtccggaatcgaaaacacctttcaacacgtcaaggaacttgtgtctgagaaatggaaaccgctcctgtatattctgtactgttttacttcgggcttctgttaaagctgttctatggccttggattttatggaggcagatctctgtatcatccagagcctgagtacagtttccttccaaatggacaatgacccaggtggccaaagaatgttcatgagttttataaaagtattgatggtcacaggtgataaagtcagtttttaccactatcttaggcttattatagctaacattaaattactctggaaaaagatgtatattgtttcttaatgaagatgaaaaatatgtaattcatataaatcaactgtttatatcccaagactttaaagaaagacattttttaatgcctgaatgatgagaattgtacagtttttgcctcataagcaaacttgaatcacctgtgtatgaacagggaatgaacacattgcaatggctttaaatgctcttttatctcgttgtaaaggtaaggcaagattttgatgtagtaggatgtaggtaatgtatttaaatatttcatatgaccatatcgtgtccaaactcagtctgagaatgtgacagctttccgcctaactagaatgcagaccagaatgagttcaactcattctgtgcaacttcacagggggtttattagaatgctcagtgtagaggacattcctgtcatccatgccaactacctaactcgttatcagagctgatagagcatgggaaaagtctgtccagcgattcagttgttcccctccttccaaaaacagcctccaataccacaacctggaaaggggccgaatgggttatttttacagcntacaggttntgntccngtatggttatttttnattgccnagggtcttggggtc

SEQ ID NO: 734507 - DNA, 452 bp, Homo sapiens; identical to SEQ ID NO: 728892

SEQ ID NO: 734508 - DNA, 1490 bp, Homo sapiens
gtccctgcgtctttccttccttctctctttcgctctctctgccaactgctatgggtttccataactctgcaatcaaagtggatggtcgggaaggattattacacagagtgaagcctccgctgttaatgtctccagtgtttaatcatcatacagtaaatggttttatgcatatttcatttgcatatcattaaactgtgttagtgaggggcattcagaaccaggagaagtacaaagttggggagagagggaagaaaaaaaggtccctatgatgcttatcttcaaacggggacttgttccatgatctgtcttctacttttgctaaaatcattatgacttggaaacctttgaagttggatacaaccttggattcttctaattcctgcagagcagtgtattttacaaaacagcagaaatgttcctgcactagacaattaaaggaatataaactccagtgggctgaaactagtagctctttggggaatgcagtagcagaggcttctacaaataccaacacttaaaaatatataataaacagcatcatattagaaacaaagaaaacgaagacaagaaatattaacacgtggattatatttgtttcttttggggggtaatgaactaaagagaatgaagaagccatcggtaatttatcccttcattaatgaacagtcacctttttgtatgtgtttgtttttgtcctttctttttgaagagggatgttgttacttttgaagcaattagtcaattattttgtagctctgatcttttccccctgcacccgacaggacagaaaggtggtggttagggaatatgtgagtacttggggagggggggacttggtggggagagaaagaatacagtgagttctttgtagatcttatacatgcacaacatattaattgggggcttttaaagctccctcaatgggctatttcattcctggtaaaacagcagctggttagccactactggtgactcttcaaatattacttcatttttattctgtcgccgttgttgttgtcttgctttgtttttcctcagttaagaatgaaaatgtagtatcaccccctctttagtgagtctcttctccatcttcttcactccaatttccaaactgtaaaacaatgttggcttaatactgagtcctggtgcacagtctaactggcacaacttgatttggaaatgagatgctgctttatatttaaattaccccggctccccccttatcctccaaagctttgtctctgttatgaatatgcagatgaggcctgatgtgattacactgtacaattactcctatccatggtggtgtcaggggctgctagggagacagagagtcagacagcctccaagccaatacagagttttgttttcggtatttttcctatctccttggcactgcggcacatgcagatgtcgctgttgttctttataaagccctaatgtatgcaaaagcataacgatttggtttggacgcaaagcatcaacgaaat

SEQ ID NO: 734509 - DNA, 723 bp, Homo sapiens
acagacgtctcaggaaactgggggcaacctggggggagccccgtgggctgtgggaacccctgcccccggcttggaagctgcccacagtggcctggttgcagcctggcagatgaggggtacatcactactcagaataaacggccccctctgcacccacctgtctagatgagggtgacaggcactatcacagggcccccacctgacgccttcccacctggccatgcccccccagaactgtcatggagcccaggaggcgcctgtgtggagcacggggacctggcacgctgctgcccctagatctcagactcccatctaaggaccagacctgctgcctgtgcccagggaggggccctgacaccctctgtccccgtcagaacagggccccaagccactgcattgctccgtcctcacatgccctccctttcctcgcaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 734510 - DNA, 1924 bp, Homo sapiens; identical to SEQ ID NO: 419448
  misc_feature (1118)..(1118): n is a, c, g, or t

SEQ ID NO: 734511 - DNA, 3917 bp, Homo sapiens
gccaagcgaggcgggagtcatttcctgggagagtgtcccccaccctggctctgtgcaccccaccttgaggccctgcagcttcagccgcagtggggaaggggaggggctgggctgatggcgaatcgggttcaggagggcagcagtgccctgtggccgtctcagtagctctaaaacaggctcaacaacatgccccgcccctttctctgggcctcatctaagcctggccagggccctgtgggcccgcctctctctgcgcctcacgcaggcaacagatggttccactgctggcccaccagtcacctgcacgatggctcctccctcagaacagcactcccaccccggccccagcaccttcacatctgggcacaggcaggtccctgcctgcctcatcgtcccctctgtccccagcccaagaaggagttcagatcctgtgtgtgaatggccacccctcacccacccagccctgtgctgagttccttgtgcagggacattgctttgagacttggcaccatcagcccctggtccttagggtctcagagcaaggtcatccctcagcaggcttctggcctgtgcgctcctcagcacctctgcccaggtctctcccaaccatcacagacgctgtgtgagcctggacttcctgccttatccccactgtggcccaaacagcatgggggcaagctcagaacacacacctgggcttctgggccttgtggcccgtgggggtgatgtgggaacttctacttcctttccaaacaaatattcagtaactagtccactgttaccacttaggcagctaagcaagaaaggtgccagaaatgaagagggaagccatatcattgaggagagaatgaaaagtattaaaaaggaacaaagagagacccttgatattgacagaaggaaaacccaccaagatcaccagtgcagcattgcgtgcaccaaagcataccccaaagaggtgagcgcaaaacagcttcagggcaaacacttcatctatgattcaactgttccaggaactgaccagacctggagaccaaatagagagtcataggcagggtcagcaggatgggagagagcgcctgcacccacaggagccacagccctgactgaggccaggaagcagccccaaatgccagctcccactgcagcatgagaacagaaacagaccactgaaaattcccaaagtctgtggacaaatcagacgtcgaagaagtcacgtggcatcgagacagattttgcactgagggacaaggagagcatgtggccaaagtaggtgcaggtaaagcagcatctggggcagagttatagccttcagtgcaggtatcagacacagttgttgagagcagcagcccaagccagcccctccgtcctgcagggaggacacctaggtcacttggcttctgttggggagctgagttgcttcagattgtgtgaccagcaaaacagcttggttgctctcacttggtttctccagggcggggaattacatgtccccagctgaactgagaaggctctttgagcagtggagtgagcaggctttgtcatgaggcaggagtggggctagaatcaagcccagagcccacagggcatccagagccttccaaaggagcccctctcctggggctctccaatttgatgaagggactgggcactgggtggctgagaccacattggcagccaggaggaggcagcctggccggggggaaccagggtggctctaatccccaccaccccctcagctgccctacccccgccacgctggtgtgacaccagtgatgctcagcctcaaaaggggagtccggctgtcttcgggaaactgactttatgctggaggccaattaaaatggcacagcaaaggcagcggccagctggtgcccaggcagcttagggactggtccctgaggccccacccgccccagcctgtgcagtggagctgagtacgaatcaaaggtgaggatggcaagggagctgagagcagcctccggatgcaccaaaccggcctggctcctgtttgcaggaaggcagcctccccgagacccagccgacctgcacgtctcccatcagccccgactccaccgcatccctctgggtccttttaggagcccccagggactgagccggggctcacgctcctggccagagcgctgggtttctggcaatgcctcccctcctgcctttacggccacagctctcccctccagaggcccctctgtagtgggcctcggtcccctctccacccccagaggcagcacagcttcagccctacgcagtgtgggggctccgggaggaaatgcagggaggtgcttggtcttggcccagagctcatggccttaggtgctgcccccagtcacccccgtgcccatgcagccggggatgttcagctcaggccagccaccgaggtggtgtgacgcaaggctgatctgacgctcagctcaggccgctggggtcatgggggttgtgggaaggtcatggaatcacggggctcacgctggggtcacagggtggtgtggctgtgtggactgtaaggggcgtgcagccatgcgtatctgacctgccctccctaggtctgcaggcagtgccgagtggctctgcctgaggccccaagagcgaccttggaagctccaggccttcacagcccctctgagagccacctgcaaggtggggagctgggaagaacggctcagtgatgagctcagagggaggggtgggcacagcgcccaggaaggcgggtgcgtgcaggcctgggaggaatgtgtagcaggaggcagggggtgctgtgcccgcaggaccagcaggtgaggcgtgtccacccacaggatggctctggcccaggcagtgtcagaaatggaagctgaggaaacccaaccccagctgtagaggagcctgccccgatgccatctgcacctggggggcgacgtatggctgccagcctcttcatctaccaaggaccagggcagtggggacgggagagctgggacacgtggactcacaccagggcagatggtgggggaagccagtgtctgtagattcagtgcatttcttggggaagggcgtggaacatttggacttgagccccagcacagagacgatgtcataatacagccccccatcgtgatctgatggtaagtacagaactccttgcccagtggagaaacactctcctctcatgtgtggaatatccacacactaaccatgaactgggccataagaaaccttacattccaaaggatcctgctgttcagaactcactcactcactgatgaaactggaaaaacaaccaatgataacaagctaaagaatgcctctagaagctaaaagacacacccatgactccacagtaattcatgggttaaagagaaaaaaggaaacgtgaagatacttgtaaccaaataatgatggatgcagcgccacgtcagaatctctgtgctgcagctgcagtggtacctagagggcaatttatagctgtaaatacagtgctttgttttgttttcttgttttttgagacaaggtcttgctctgtcacccaggctggagtacagtggcatgatctcggctcaatgcaacctctgtgccaccctgggctcaagtggtcctcctgctccggtcttctgagtagcaggaaccacaggcgtgcgccaccacgcttggctaatgttttttgtatttttttaaatagagacagggtgttgccgtgttacccaggctggtcttgaacttctgagctcaaacgatccaccctccttggcctcccaaagtggtgggattacaggtgtgagtcacctcaccggcccttaaacacagtttttagggaagattccaactcaaacaattttaaatagtagaaaataaaccctgaagcagtgtgcattcattagtactgtgtttgcctgtatttaattaaaacctgattgccattggct

SEQ ID NO: 734512 - DNA, 1881 bp, Homo sapiens
ccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 734513 - DNA, 1977 bp, Homo sapiens
ccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggagagcccgggccacccggacagatgggaccagaaggtcctggaggccagcagggctcgccggggacccagggccgtgcagtccaggggcctgtgggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 734514 - DNA, 761 bp, Homo sapiens
ttcataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcacacacacggggagcccagaccctgagcaggcttctgagccccaagttgccttcacaaccaagccaggatccgcgcactcctgccggcccccagtaccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtag

SEQ ID NO: 734515 - DNA, 1207 bp, Homo sapiens
gggctgtggagaacctcccgtgccgtctcacaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 734516 - DNA, 356 bp, Homo sapiens
tgacgtctacccagcccccctacctccagagcacaccatcgtcttccttgtgcgcctacttcccgagacaccccgtgaggccttcgcgctgtggcagatgacagccgaggacttccagcccctccttggggttctgctggatggtgacgtgggccccgcgtcgcccccagcagtcaggaggagtaggggcagggaggccccagagccctgggaggccttcagaggaagtccagcctccaggccaggccctcagcaccctctgggtgggaggcaggtgtcccgggcagggggctgtgggccacattgagggtcacctccagcttggcaccctcagggctgctcctgtcctgtcgtgg

SEQ ID NO: 734517 - DNA, 1189 bp, Homo sapiens
gggctgtggagaacctcccgtgccgtctcacaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctcacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 734518 - DNA, 1863 bp, Homo sapiens
ccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctcacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 734519 - DNA, 1827 bp, Homo sapiens
ccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 734520 - DNA, 8044 bp, Homo sapiens
  misc_feature (1927)..(1927): n is a, c, g, or t
gtcagggagaggacagacggggggacggctgaagggcatggcctcttccctgccacagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcacacacacggggagcccagaccctgagcaggcttctgagccccaagttgccttcacaaccaagccaggatccgcgcactcctggtgggtcagagtggagagagaccggcccccagtaccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggaggggcccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccangctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcacccagccaagcgaggcgggagtcatttcctgggagagtgtcccccaccctggctctgtgcaccccaccttgaggccctgcagcttcagccgcagtggggaaggggaggggctgggctgatggcgaatcgggttcaggagggcagcagtgccctgtggccgtctcagtagctctaaaacaggctcaacaacatgccccgcccctttctctgggcctcatctaagcctggccagggccctgtgggcccgcctctctctgcgcctcacgcaggcaacagatggttccactgctggcccaccagtcacctgcacgatggctcctccctcagaacagcactcccaccccggccccagcaccttcacatctgggcacaggcaggtccctgcctgcctcatcgtcccctctgtccccagcccaagaaggagttcagatcctgtgtgtgaatggccacccctcacccacccagccctgtgctgagttccttgtgcagggacattgctttgagacttggcaccatcagcccctggtccttagggtctcagagcaaggtcatccctcagcaggcttctggcctgtgcgctcctcagcacctctgcccaggtctctcccaaccatcacagacgctgtgtgagcctggacttcctgccttatccccactgtggcccaaacagcatgggggcaagctcagaacacacacctgggcttctgggccttgtggcccgtgggggtgatgtgggaacttctacttcctttccaaacaaatattcagtaactagtccactgttaccacttaggcagctaagcaagaaaggtgccagaaatgaagagggaagccatatcattgaggagagaatgaaaagtattaaaaaggaacaaagagagacccttgatattgacagaaggaaaacccaccaagatcaccagtgcagcattgcgtgcaccaaagcataccccaaagaggtgagcgcaaaacagcttcagggcaaacacttcatctatgattcaactgttccaggaactgaccagacctggagaccaaatagagagtcataggcagggtcagcaggatgggagagagcgcctgcacccacaggagccacagccctgactgaggccaggaagcagccccaaatgccagctcccactgcagcatgagaacagaaacagaccactgaaaattcccaaagtctgtggacaaatcagacgtcgaagaagtcacgtggcatcgagacagattttgcactgagggacaaggagagcatgtggccaaagtaggtgcaggtaaagcagcatctggggcagagttatagccttcagtgcaggtatcagacacagttgttgagagcagcagcccaagccagcccctccgtcctgcagggaggacacctaggtcacttggcttctgttggggagctgagttgcttcagattgtgtgaccagcaaaacagcttggttgctctcacttggtttctccagggcggggaattacatgtccccagctgaactgagaaggctctttgagcagtggagtgagcaggctttgtcatgaggcaggagtggggctagaatcaagcccagagcccacagggcatccagagccttccaaaggagcccctctcctggggctctccaatttgatgaagggactgggcactgggtggctgagaccacattggcagccaggaggaggcagcctggccggggggaaccagggtggctctaatccccaccaccccctcagctgccctacccccgccacgctggtgtgacaccagtgatgctcagcctcaaaaggggagtccggctgtcttcgggaaactgactttatgctggaggccaattaaaatggcacagcaaaggcagcggccagctggtgcccaggcagcttagggactggtccctgaggccccacccgccccagcctgtgcagtggagctgagtacgaatcaaaggtgaggatggcaagggagctgagagcagcctccggatgcaccaaaccggcctggctcctgtttgcaggaaggcagcctccccgagacccagccgacctgcacgtctcccatcagccccgactccaccgcatccctctgggtccttttaggagcccccagggactgagccggggctcacgctcctggccagagcgctgggtttctggcaatgcctcccctcctgcctttacggccacagctctcccctccagaggcccctctgtagtgggcctcggtcccctctccacccccagaggcagcacagcttcagccctacgcagtgtgggggctccgggaggaaatgcagggaggtgcttggtcttggcccagagctcatggccttaggtgctgcccccagtcacccccgtgcccatgcagccggggatgttcagctcaggccagccaccgaggtggtgtgacgcaaggctgatctgacgctcagctcaggccgctggggtcatgggggttgtgggaaggtcatggaatcacggggctcacgctggggtcacagggtggtgtggctgtgtggactgtaaggggcgtgcagccatgcgtatctgacctgccctccctaggtctgcaggcagtgccgagtggctctgcctgaggccccaagagcgaccttggaagctccaggccttcacagcccctctgagagccacctgcaaggtggggagctgggaagaacggctcagtgatgagctcagagggaggggtgggcacagcgcccaggaaggcgggtgcgtgcaggcctgggaggaatgtgtagcaggaggcagggggtgctgtgcccgcaggaccagcaggtgaggcgtgtccacccacaggatggctctggcccaggcagtgtcagaaatggaagctgaggaaacccaaccccagctgtagaggagcctgccccgatgccatctgcacctggggggcgacgtatggctgccagcctcttcatctaccaaggaccagggcagtggggacgggagagctgggacacgtggactcacaccagggcagatggtgggggaagccagtgtctgtagattcagtgcatttcttggggaagggcgtggaacatttggacttgagccccagcacagagacgatgtcataatacagccccccatcgtgatctgatggtaagtacagaactccttgcccagtggagaaacactctcctctcatgtgtggaatatccacacactaaccatgaactgggccataagaaaccttacattccaaaggatcctgctgttcagaactcactcactcactgatgaaactggaaaaacaaccaatgataacaagctaaagaatgcctctagaagctaaaagacacacccatgactccacagtaattcatgggttaaagagaaaaaaggaaacgtgaagatacttgtaaccaaataatgatggatgcagcgccacgtcagaatctctgtgctgcagctgcagtggtacctagagggcaatttatagctgtaaatacagtgctttgttttgttttcttgttttttgagacaaggtcttgctctgtcacccaggctggagtacagtggcatgatctcggctcaatgcaacctctgtgccaccctgggctcaagtggtcctcctgctccggtcttctgagtagcaggaaccacaggcgtgcgccaccacgcttggctaatgttttttgtatttttttaaatagagacagggtgttgccgtgttacccaggctggtcttgaacttctgagctcaaacgatccaccctccttggcctcccaaagtggtgggattacaggtgtgagtcacctcaccggcccttaaacacagtttttagggaagattccaactcaaacaattttaaatagtagaaaataaaccctgaagcagtgtg

SEQ ID NO: 734521 - DNA, 2194 bp, Homo sapiens
ccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgccggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcggtgtgccccgtcccttgcccctgttccacgaagcaagttagggcaagtgcccactgagggtcacagtgcctgggagggatggagagacctgccccgccttcgtgtctgcctgttcctgttcctcagagacccctgggcccccaggacctcaaggacccccagttccagcgccccacaggtgacggctggggcttccagagctggctctgggaccggtcaagcacactctctctgagctcagtgtccacagccttgtctactcagggggccggggtttgaacccagaactgcctgactatgagagggcctccctgggaggaatggcaccccaggagagcagggcttcccagggcccaggggagagcccgggccacccggacagatgggaccagaaggtcctggaggccagcagggctcgccggggacccagggccgtgcagtccaggggcctgtgggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 734522 - DNA, 1602 bp, Homo sapiens
gcgttcgcagccgccggtcatcccgcggaggagcgcgcaccccggggaggccggaggacgcgcccatagaatgcccaggggcgacaaactgtcctgagcccctctggtgcagccacctgcctgtcccatacgccccgcccaccatggagtccagagggaagtcagccagcagccccaagcccgacaccaaggtgccccaggtcaccaccgaggccaaggtacccccggcagccgatgggaaagcccccttgaccaagccctcgaagaaggaggccccggccgagaagcagcagccgccagcagcccccaccacggcacctgccaagaagacctcggccaaggccgaccctgcccttctcaacaaccacagcaacctgaagccagcccccacggtccccagcagtcccgatgcaaccccggagcccaagggtcctggggacggggcggaggaagatgaggctgccagtggggggcctgggggccgaggtccctggtcctgtgagaacttcaaccccctgctggtggctgggggtgtggccgtggcagccatagccctgattctcggtgtggccttcctggtccggaaaaaataatacctgggggccaggcggggggcacggagccacttcctgtacagacccgaggaagccagtgcatgcagagttcacccttacctattcgtacacacgcacattcattacacacctacatacgcccccaacacacgcgcacggtgaagaggacgcccgagcccacccctgctgacccaggacttccccaacctccagggcagaaagagcccaggctccggggtccacagcacaggatgtggggcgagggcacagctggggaacggcaagaaaggaatggaccctgtgtgtggccccccccacccctggcggctgggtgatcctgggcccccagggctggtctgagtgcaggtgggggtgccgggatgggttgggcctgggcccggccctcgtggggacattaaagggcgcggtggctccactcgccccatttctgctctttgcgtaccccccgggggtctgcctgggcgaatgcagtgggacggacctggggtgggcactcacctcagcagagcctcaatgccacctccccacaccacccaagcctagctgggtgggaagacggagccctgaagcctgcgtgtggagggggtgctgcccaagggtcgccttccccagcttgtgctccaggggagccccgacgccggcggggaggcagggatgtcgagggcccctcacagctgtgcccgccctgccccgctagactgcccctccagcttgcacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactgccagtggccacaggaaccccgggcctgagtggaggctgagtctgaaataaactctgtcgtctg

SEQ ID NO: 734523 - DNA, 381 bp, Homo sapiens; identical to SEQ ID NO: 667361

SEQ ID NO: 734524 - DNA, 1186 bp, Homo sapiens
gcgttcgcagccgccggtcatcccgcggaggagcgcgcaccccggggaggccggaggacgcgcccatagaatgcccaggggcgacaaactgtcctgagcccctctggtgcagccacctgcctgtcccatacgccccgcccaccatggagtccagagggaagtcagccagcagccccaagcccgacaccaaggtgccccaggtcaccaccgaggccaaggtacccccggcagccgatgggaaagcccccttgaccaagccctcgaagaaggaggccccggccgagaagcagcagccgccagcagcccccaccacggcacctgccaagaagacctcggccaaggccgaccctgcccttctcaacaaccacagcaacctgaagccagcccccacggtccccagcagtcccgatgcaaccccggagcccaagggtcctggggacggggcggaggaagatgaggctgccagtggggggcctgggggccgaggtccctggtcctgtgagaacttcaaccccctgctggtggctgggggtgtggccgtggcagccatagccctgattctcggtgtggccttcctggtccggaaaaaataatacctgggggccaggcggggggcacggagccacttcctgtacagacccacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactgccagtggccacaggaaccccgggcctgagtggaggctgagtctgaaataaactctgtcgtctgaaaaaaaaaaaactcaaccaactacaaaggggccgcgactacaaaaaacaccccgaagagcccaaacaaaacagacaccatatcgcgatcaagaccggcccaagaagagacataataacacgagcgaggccgcgaaacaacgacgtggtcggcgagagctagcacgcgactacgagcagggaaccaccagcggcggcaagaagacgcacaacagaaaaccgacgcaccaaacgacggcgacaacgcatcgtagc

SEQ ID NO: 734525 - DNA, 1856 bp, Homo sapiens
gcgttcgcagccgccggtcatcccgcggaggagcgcgcaccccggggaggccggaggacgcgcccatagaatgcccaggggcgacaaactgtcctgagcccctctggtgcagccacctgcctgtcccatacgccccgcccaccatggagtccagagggaagtcagccagcagccccaagcccgacaccaaggtgccccaggtcaccaccgaggccaaggtacccccggcagccgatgggaaagcccccttgaccaagccctcgaagaaggaggccccggccgagaagcagcagccgccagcagcccccaccacggcacctgccaagaagacctcggccaaggccgaccctgcccttctcaacaaccacagcaacctgaagccagcccccacggtccccagcagtcccgatgcaaccccggagcccaagggtcctggggacggggcggaggaagatgaggctgccagtggggggcctgggggccgaggtccctggtcctgtgagaacttcaaccccctgctggtggctgggggtgtggccgtggcagccatagccctgattctcggtgtggccttcctggtccggaaaaaataatacctgggggccaggcggggggcacggagccacttcctgtacagacccgaggaagccagtgcatgcagagttcacccttacctattcgtacacacgcacattcattacacacctacatacgcccccaacacacgcgcacggtgaagaggacgcccgagcccacccctgctgacccaggacttccccaacctccagggcagaaagagcccaggctccggggtccacagcacaggatgtggggcgagggcacagctggggaacggcaagaaaggaatggaccctgtgtgtggccccccccacccctggcggctgggtgatcctgggcccccagggctggtctgagtgcaggtgggggtgccgggatgggttgggcctgggcccggccctcgtggggacattaaagggcgcggtggctccactcgccccatttctgctctttgcgtaccccccgggggtctgcctgggcgaatgcagtgggacggacctggggtgggcactcacctcagcagagcctcaatgccacctccccacaccacccaagcctagctgggtgggaagacggagccctgaagcctgcgtgtggagggggtgctgcccaagggtcgccttccccagcttgtgctccaggggagccccgacgccggcggggaggcagggatgtcgagggcccctcacagctgtgcccgccctgccccgctagactgcccctccagcttgcacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactgccagtggccacaggaaccccgggcctgagtggaggctgagtctgaaataaactctgtcgtctgaaaaaaaaaaaactcaaccaactacaaaggggccgcgactacaaaaaacaccccgaagagcccaaacaaaacagacaccatatcgcgatcaagaccggcccaagaagagacataataacacgagcgaggccgcgaaacaacgacgtggtcggcgagagctagcacgcgactacgagcagggaaccaccagcggcggcaagaagacgcacaacagaaaaccgacgcaccaaacgacggcgacaacgcatcgtagc

SEQ ID NO: 734526 - DNA, 1189 bp, Homo sapiens
gcgttcgcagccgccggtcatcccgcggaggagcgcgcaccccggggaggccggaggacgcgcccatagaatgcccaggggcgacaaactgtcctgagcccctctggtgcagccacctgcctgtcccatacgccccgcccaccatggagtccagagggaagtcagccagcagccccaagcccgacaccaaggtgccccaggtcaccaccgaggccaaggtacccccggcagccgatgggaaagcccccttgaccaagccctcgaagaaggaggccccggccgagaagcagcagccgccagcagcccccaccacggcacctgccaagaagacctcggccaaggccgaccctgcccttctcaacaaccacagcaacctgaagccagcccccacggtccccagcagtcccgatgcaaccccggagcccaagggtcctggggacggggcggaggaagatgaggctgccagtggggggcctgggggccgaggtccctggtcctgtgagaacttcaaccccctgctggtggctgggggtgtggccgtggcagccatagccctgattctcggtgtggccttcctggtccggaaaaaataatacctgggggccaggcggggggcacggagccacttcctgtacagacccgaggaagccagtgcatgcagagttcacccttacctattcgtacacacgcacattcattacacacctacatacgcccccaacacacgcgcacggtgaagaggacgcccgagcccacccctgctgacccaggacttccccaacctccagggcagaaagagcccaggctccggggtccacagcacaggatgtggggcgagggccgagggcccctcacagctgtgcccgccctgccccgctagactgcccctccagcttgcacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactgccagtggccacaggaaccccgggcctgagtggaggctgagtctgaaataaactctgtcgtctg

SEQ ID NO: 734527 - DNA, 1421 bp, Homo sapiens
  misc_feature (71)..(71): n is a, c, g, or t
  misc_feature (73)..(74): n is a, c, g, or t
  misc_feature (79)..(80): n is a, c, g, or t
ttaactttaaccttcttaaatatttggagatgaatgataattgtaatatttgtttgcattaccttgctctncnncaccnncagccaccagcagggggtgtggccgtggcagccatagccctgattctcggtgtggccttcctggtccggaaaaaataatacctgggggccaggcggggggcacggagccacttcctgtacagacccgaggaagccagtgcatgcagagttcacccttacctattcgtacacacgcacattcattacacacctacatacgcccccaacacacgcgcacggtgaagaggacgcccgagcccacccctgctgacccaggacttccccaacctccagggcagaaagagcccaggctccggggtccacagcacaggatgtggggcgagggcacagctggggaacggcaagaaaggaatggaccctgtgtgtggccccccccacccctggcggctgggtgatcctgggcccccagggctggtctgagtgcaggtgggggtgccgggatgggttgggcctgggcccggccctcgtggggacattaaagggcgcggtggctccactcgccccatttctgctctttgcgtaccccccgggggtctgcctgggcgaatgcagtgggacggacctggggtgggcactcacctcagcagagcctcaatgccacctccccacaccacccaagcctagctgggtgggaagacggagccctgaagcctgcgtgtggagggggtgctgcccaagggtcgccttccccagcttgtgctccaggggagccccgacgccggcggggaggcagggatgtcgagggcccctcacagctgtgcccgccctgccccgctagactgcccctccagcttgcacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactgccagtggccacaggaaccccgggcctgagtggaggctgagtctgaaataaactctgtcgtctgaaaaaaaaaaaactcaaccaactacaaaggggccgcgactacaaaaaacaccccgaagagcccaaacaaaacagacaccatatcgcgatcaagaccggcccaagaagagacataataacacgagcgaggccgcgaaacaacgacgtggtcggcgagagctagcacgcgactacgagcagggaaccaccagcggcggcaagaagacgcacaacagaaaaccgacgcaccaaacgacggcgacaacgcatcgtagc

SEQ ID NO: 734528 - DNA, 1167 bp, Homo sapiens
  misc_feature (71)..(71): n is a, c, g, or t
  misc_feature (73)..(74): n is a, c, g, or t
  misc_feature (79)..(80): n is a, c, g, or t
ttaactttaaccttcttaaatatttggagatgaatgataattgtaatatttgtttgcattaccttgctctncnncaccnncagccaccagcagggggtgtggccgtggcagccatagccctgattctcggtgtggccttcctggtccggaaaaaataatacctgggggccaggcggggggcacggagccacttcctgtacagacccgaggaagccagtgcatgcagagttcacccttacctattcgtacacacgcacattcattacacacctacatacgcccccaacacacgcgcacggtgaagaggacgcccgagcccacccctgctgacccaggacttccccaacctccagggcagaaagagcccaggctccggggtccacagcacaggatgtggggcgagggcacagctggggaacggcaagaaaggaatggaccctgtgtgtggccccccccacccctggcggctgggtgatcctgggcccccagggctggtctgagtgcaggtgggggtgccgggatgggttgggcctgggcccggccctcgtggggacattaaagggcgcggtggctccactcgccccatttctgctctttgcgtaccccccgggggtctgcctgggcgaatgcagtgggacggacctggggtgggcactcacctcagcagagcctcaatgccacctccccacaccacccaagcctagctgggtgggaagacggagccctgaagcctgcgtgtggagggggtgctgcccaagggtcgccttccccagcttgtgctccaggggagccccgacgccggcggggaggcagggatgtcgagggcccctcacagctgtgcccgccctgccccgctagactgcccctccagcttgcacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactgccagtggccacaggaaccccgggcctgagtggaggctgagtctgaaataaactctgtcgtctg

SEQ ID NO: 734529 - DNA, 754 bp, Homo sapiens
  misc_feature (71)..(71): n is a, c, g, or t
  misc_feature (73)..(74): n is a, c, g, or t
  misc_feature (79)..(80): n is a, c, g, or t
ttaactttaaccttcttaaatatttggagatgaatgataattgtaatatttgtttgcattaccttgctctncnncaccnncagccaccagcagggggtgtggccgtggcagccatagccctgattctcggtgtggccttcctggtccggaaaaaataatacctgggggccaggcggggggcacggagccacttcctgtacagacccgaggaagccagtgcatgcagagttcacccttacctattcgtacacacgcacattcattacacacctacatacgcccccaacacacgcgcacggtgaagaggacgcccgagcccacccctgctgacccaggacttccccaacctccagggcagaaagagcccaggctccggggtccacagcacaggatgtggggcgagggccgagggcccctcacagctgtgcccgccctgccccgctagactgcccctccagcttgcacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactgccagtggccacaggaaccccgggcctgagtggaggctgagtctgaaataaactctgtcgtctg

SEQ ID NO: 734530 - DNA, 123 bp, Homo sapiens
gccatggagaagtgtaaagatgcaggattggccaagtccatcggggtgtccaacttcaaccacaggcagctggagatgatcctcaacaagccagggctcaagtacaagcctgtctgcaaccag

SEQ ID NO: 734531 - DNA, 81 bp, Homo sapiens
ccttctctctctctctccctctccctctcctgccagccaagtgaagacatgcttacttccccttcaccttccttcatgatg

SEQ ID NO: 734532 - DNA, 60 bp, Homo sapiens
tttatcatttcaggatctctctccgtggcagcagaaaatcagccatattcttattgcctg

SEQ ID NO: 734533 - DNA, 512 bp, Homo sapiens
gtgagtgtcatctatccaaacatctatgcagcaaacccagtgatcaccccagaaccggtgacctcaccaccaagttattccagtgagatccaagcaaataagtaaggctacagattctggaagcatctttcactgggaccaaaagaagtcctcctccctttctgggcttccataacccaggtcgttcctgttctgacagctgaggaaacgtctctcccactgtttgtactctcaccttcattcttcaattcagtctaggaaaccatgctgtttctctatcaagaagaagacagagattttaaacagatgttaaccaagagggactccctagggcacatgcatcagcacatatgtgggcatccagcctctggggccttggcacacacacattcgtgtgctctgctgcatgtgagcttgtgggttagaggaacaaatatctagacattcaatcttcactctttcaattgtgcattcatttaataaatagatactgagcattcaaaaaaaaaaag

SEQ ID NO: 734534 - DNA, 419 bp, Homo sapiens
gtgcagctggaggttcagaagaagtggcagcaatggcacctccgtgagttcccactgcaccccgtggcctccttcagcaacagcaccaaggccagccacttggagcagagccagggcacctgcaggaccagcatcatctgagaggctggagcagggtcacccatggacagagaccaagagaggtcctgcgaaggctgggcactgctgtgggacagccagtcttcccagcagacaccctgtgtcctccttcagctgaagatgcccctccccaggccttggactcttccgaagggatgtgaggcactgtggggcaggacaagggcctgggatttggttcgtttgctcttctgggaagagaagttcaggggtcccagaaagggacagggaaataaatggtgcctgggatgagattcaatcta

SEQ ID NO: 734535 - DNA, 3720 bp, Homo sapiens
gtgaagtgcttcttctgcatgattttggctgaagaatgctctgcatttccttgatttctatggagacctcagagctggttttgcttctgctgacacctcatctagcaccttctctacctcccagggtctttgcctctatctgtggtttggcattgtacctgggtacaggaagcctttgatgaacttaaaaggagagcctggagaatcatcctgatagactttgagtagaaatggctggacatacttcaaaccacatcttaacatggttcgagccatcactagaaggcaagtgctaacagtaaaggcttatttgcattttatttacatttaatggactgagcattggccaatttccatggcagaaaaatatatttcattttctaggcacaacttctggctgtcagacacttgctgcctttgaatcttgcagcaacatcactaaccacatcccagacatatttccaaatttcaacatctacccccaaaacataggtgtctgagagactccagcattttcggacttcttagtcttgagagtgccaggctatttatctcgaccagccaagctctggagagcaatgttgaatccctgagaagagagagcatggggcgtgctgatttaaaaacagaaaatgcaaagttggactgaaaatatccttagtcttccaagcaatctgcttaagggttccaaacttaccttaatttggtgagaaaagaagctgccctatttttctttcttcttcttctacaactggaaccagccatttccgaaaaccaccaccatggaggttgcaatggtgagtgcggagagctcagggtgcaacagtcacatgccttatggttatgctgcccaggcccgggcccgggagcgggagaggcttgctcactccagggcagctgcagcagctgctgttgcagcggccacagctgctgtcgaaggtagcgggggttctggtgggggctcccaccaccaccaccagtcacgcggggcctgtacctcccatgaccctcagagcagccggggtagtcggaggaggaggcgacagcggtctgagaagaagaaagcccactaccggcagagcagcttccctcattgctctgacctgatgcccagtggctctgaggagaagatcctgagggagctgagtgaggaggaggaagatgaggaggaggaggaagaggaggaagaggagggaaggttttactatagtgaagatgaccatggtgatgagtgttcctacacggatctgctgcctcaggatgagggcggtggcggctacagttcagtccgctacagtgactgttgtgaacgtgtggtgataaatgtgtcaggcctacgctttgagacccaaatgaaaactctggcccagtttccagagactttgttgggagaccctgaaaagaggactcagtactttgaccctttgcgcaatgagtatttttttgacaggaaccgccccagctttgatgccatcttgtattattatcaatcaggaggccgcctgaagaggccagtcaatgtcccctttgatatcttcactgaggaggtgaagttctatcagttgggggaggaggccctgttgaagtttcgggaggacgagggctttgtgagagaagaggaagacagggccctccccgagaatgaatttaaaaagcagatttggctcctctttgaatatccagagagctccagtcctgcaaggggcatagccattgtgtccgtcctggtcatcttaatctccattgtcatcttttgcctggaaaccttgcctgagtttagggacgacagggatctcgtcatggcactgagtgctggcgggcatggtgggttgttgaatgatacttcagcaccccatctggagaactcagggcacacaatattcaatgaccccttcttcatcgtggaaacagtctgtattgtatggttttcctttgagtttgtggttcgctgctttgcttgtcccagccaagcactcttcttcaaaaacatcatgaacatcattgacattgtctccattttgccttacttcatcacactgggcactgacctggcccagcaacaggggggtggcaatggtcagcagcagcaggccatgtcctttgccatcctcagaatcattcgtctggtccgagtattccggatcttcaaactctccaggcactccaaaggcctgcagatcctgggccacaccctcagagccagcatgcgggaactgggccttctgatcttcttcctcttcattggggtcatcctcttttctagtgctgtgtattttgcagaggcggatgaacctactacccatttccaaagcatcccagatgcattttggtgggctgtggtgaccatgacaactgtgggctatggggacatgaagcccatcactgtagggggcaagattgtcgggtccctgtgtgccattgcgggtgtcttaaccattgctttgccagtgccagtgattgtctctaactttaactatttctaccacagagagactgaaaatgaggaacagacacagctaacgcagaatgcagtcagttgtccatacctcccctctaatttgctcaagaaatttcggagctctacttcttcttccctgggggacaagtcagagtatctagagatggaagaaggagttaaggaatctctgtgtgcaaaggaggagaagtgtcagggaaagggggatgacagtgagacagataaaaacaactgttctaatgcaaaggctgtggagactgatgtgtgaatctttttccacctgccactgctcccccctcagcatctccaaatatatttatgcatagagagtgcagttatgaaaatgaaatatgcaaatgatccaatgcatacagtagtacactatttaatggttatacatggcataattgttactaaacttgtattacatatcaaataaatgatacatcttggagaagagggaggaataggagcaaatctatctttatatttttattagaatgcaagaattttgcacattaactggaaaagatgttaacagtaaagatggagagagagagtgtgtgcgtgtgtgtgtatatgtgtgtgtgtgtgaagtaaattgtcaatgttagtaattgtgcagtgaagggaaaagttggcattttgaagtatttactatgtaagaactaatgaatctgagcagtcatttatcagtgctttaacagcatatcgtatgtctttggattctgtagttgttttttaaaaattgtaagaaatactgtgtagagaaaaaagaaagtaaattatttaatagactataggtcacaattttatcttggatttaattaaaatttatttttaactggaaattaacttttaaaaaggctgcaagggcctttagaaattgattatattttgttattaattttgggaagacttaacagcaaatgtctaacattatagaataagtgaaattggagaatatgtaataagttttgtttgcaggtaacaggactggatttttttttctttgcactactttatatgctggagattgagagagacttcaaactgtgaatgtttactaatgtaacagttcaatgacaatcattggaagaatgatttctttagtcttattttattgtttttttttcattgtgtgagactaatgatcatgcagataacatcacaggattctctcctcttttaaaatctaaataactgattgacaaaggaattatgaagtaaaatttagcaactga

SEQ ID NO: 734536 - DNA, 739 bp, Homo sapiens; identical to SEQ ID NO: 262871

SEQ ID NO: 734537 - DNA, 306 bp, Homo sapiens
cacacagatatttttgttgtagtttcctttaaaggaataagcagctaataaagatgggttctatttatagtagtgaataaatatatttaaacatttaaaatttggtttctaaatttctatgtcttattctaatcactgatttgtaatgttatttattgtttcttttttcctacttaggtgaaatctattcttgaaagaagtaaagaggagctgtcccgaacagtgaagtgtcgtaatgcggccctgaaagagagtcagaagttgaaagaagacctcgaggctgtggaggacagggaaaacaagaag

SEQ ID NO: 734538 - DNA, 309 bp, Homo sapiens
gagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaac

SEQ ID NO: 734539 - DNA, 222 bp, Homo sapiens
tatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtgg

SEQ ID NO: 734540 - DNA, 511 bp, Homo sapiens; identical to SEQ ID NO: 222694

SEQ ID NO: 734541 - DNA, 443 bp, Homo sapiens
ctccacttctgcatgcacggccagtggtcagccacgcctttcaggatcacgggcctccctggaaccaaaaactgctccctgaaatgctggagggacggacggtgcagccgggggactgttttttctaacttcacatctggaatcaaaccatggtccgcccttgctttctgtttaaaatcaaaacagaacaaaatagcaaccacctcaggaagtcgacatttgaggtattccaccaggaacctgtgtcaggggtaggagagcttagctgtcaagagtaccagtaacaacaatagacaacgtttgttattattactgctactattactatttgctcctcatgagatcaaggtggtttttttcttaaccatttcatcaaaaatgtttgtttcattataaactgctttcacagacattctgcaataaaggaaaacttactatctcca

SEQ ID NO: 734542 - DNA, 581 bp, Homo sapiens; identical to SEQ ID NO: 271814

SEQ ID NO: 734543 - DNA, 242 bp, Homo sapiens
tgatatctgtacaccagtgttcatagcggcattattcacaatagccaaaaggcggaaacaacccaaatgtccattgacgcatgaccagtgtgatagttaatttcatgtgtcaacttgaccagcccagggaatacccggatagctggtagaaaattatttctgggtatgtctgtgagagtgtttctggaagaggttagtatttgaatcagactgagtaaaaggatccaccctatccaacatag

SEQ ID NO: 734544 - DNA, 137 bp, Homo sapiens
gtacacagctgtggccatgcccatgctgtacaatacgcgctacagctccaagcgccgggtcaccgtcatgatctccatcgtctgggtcctgtccttcaccatctcctgcccactcctcttcggactcaataacgcag

SEQ ID NO: 734545 - DNA, 1860 bp, Homo sapiens
caggcgacttcttgagctgggctttgaacagctgcggcgcaagtggggacttagccgactcctgcttcctggaggggcctgcgcccacaccccctcccggcctcagctacagcggtagcttcttcattcaggcagtgcccgaacacccgcacgacccggaggcactcttcaacctcatgtcgggcgtcttaggcctggcacccttccccggtccagaggcagcagcgtccagatccccgctggatgccccttttcctgcggggtccgatgccttgctgccgggtccgccggacctttactccccggatctgggcgctgcccctttcccagaggcgttctgggaggcctcgccttgcgcgggtgccccctcgcagtgcctgtatgagcctcagctctccccgcccgacgtcaagcccggcctccggcggcctcccgcctcgccagcgctggacgctgtctctgccttcaagggtccctacgcgccctgggagctgctttctgtgggggccccagggaactgtgggtcacagggagactaccaggccgccccggaggctcgttttcccgtaatagggaccaagattgaggacttgctgtccatcagctgccctgcggaactgccggccgtcccagccaacagactctatcccagcggggcctatgacgctttcccgctggccccgggtgacttaggggagggggctgagggcctccctgggctcctgacccctcctagtggggagggagggagtagcggcgacggcggagagtttctggccagtacgcagcctcagctttccccgctgggccttcgcagcgccgccgcggcggacttccctaaacctctggtggcggacatccctggaagcagtggcgtggctgcaccacccgtgccgccgccgccgcccacccctttcccccaggccaaggcgcgacgcaaggggcgccgcggcggcaaatgcagcacgcgctgcttctgcccgcggccgcacgccaaggccttcgcttgcccggtggagagttgtgtgcggagctttgcgcgctccgacgagctcaatcgccacctgcgcatccacacgggccacaaacccttccagtgccgcatctgcctccgcaacttcagccgcagcgaccacctcaccacgcacgtgcgcacccacaccggcgagaagccttttgcttgcgacgtgtgcggccgccgcttcgcgcgcagcgatgagaagaaacggcacagcaaggtgcacctcaagcagaaggcgcgcgccgaggagcggctcaagggcctcggcttttactcgctgggcctctccttcgcttctctctgagcaagagatgggtttatgggttggggcgccgccgttcggcgcgcacgagttccgggccgttcccctccccgctcttcttccaactcctcctcgcacgcccgagggccggcctccggtcccgcttccagtttccttgaagcgcccgccgcacacgccctattcagcaccagctccgcggacagttcccgcggtccaggcgctgtcacccttgtcagccgcgctttgggggaagtcttctgagaccacccagtgaataggcactaccctgggattcaagacagtcttttgtaactggcacacgccccacgccttcctctataacccccagagacaggctggggcagcgccaaggcggtctcgcgcgggactttgtacagcagtgtcttatccagcagccattggatgtaacgttttgctttgggttttttttccttttgttgttgttaatttttgtaaagcagacgctactctcaagcagttgacaaaactgtttatttttgcaattaaaattattgtgctaaaagcttactgaatc

SEQ ID NO: 734546 - DNA, 75 bp, Homo sapiens
acatgctgatccacggactacagtttgtcatcaaggtctaagccttccaggaaggggctggcctctgctgagctg

SEQ ID NO: 734547 - DNA, 148 bp, Homo sapiens
cttcccagtgctcacagatggctggcccatgtgctggaagatgacacagttgccttctctccgaggaacctgccccctctcctttcccaccaggcgtgtgtaacatcccatgtgcctcacctaataaaatggctcttcttatgcatca

SEQ ID NO: 734548 - DNA, 111 bp, Homo sapiens
ctcacctttgtggattttctcacctatgatatcttggatcagaaccgtatatttgaccccaagtgcctggatgagttcccaaacctgaaggctttcatgtgccgttttgag

SEQ ID NO: 734549 - DNA, 139 bp, Homo sapiens
gctggaggggcgaggaccgggtataagaagcctcgtggccttgcccgggcagccgcaggttccccgcgcgccccgagcccccgcgccatgaagctcgccgccctcctggggctctgcgtggccctgtcctgcagctccg

SEQ ID NO: 734550 - DNA, 66 bp, Homo sapiens
tacatggatcaggccagtggaaatgtaaagaaggccctgaagctgatggggtcaaatgaaggtgaa

SEQ ID NO: 734551 - DNA, 20 bp, Homo sapiens
gtagaagccctcatgctgag

SEQ ID NO: 734552 - DNA, 161 bp, Homo sapiens
gtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggc

SEQ ID NO: 734553 - DNA, 517 bp, Homo sapiens
tgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgca

SEQ ID NO: 734554 - DNA, 143 bp, Homo sapiens
ctccagccccaccgagtcactcactgtggaccctgcctctgaataatcaggaacggtggcttcagagacgtctcttgggccttccctctggccacgtctgcacccacccctcctgggcaccctcctagcctgccatccctcac

SEQ ID NO: 734555 - DNA, 42 bp, Homo sapiens
aggctggcatgggggcagccgctgcccctgcctgggtgttgc

SEQ ID NO: 734556 - DNA, 1795 bp, Homo sapiens
atggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtgcagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagcccaaaacaggcctcattccctacccttgactggtttagctgtggacatgacccacctctggccggaggagctgagctggtatctgctgggggcttcctgggaaggtttaccattttcatggaaatggttgacattacacatggtatttgtcatgccctagcatggactgtctcatactgctctggactatgtggtaataaaggctttattgtttaagccgcttaaaattttttttttattttttttttgagatggtcttattctgttgcccaggctggaatgcagtggtgccatcatagctcaccacagccttgaactgctggtctcaagggatcttcctgcttcagcctcctgagtagctggcactacaggtgtgcgccatcacacctggctaatttttttttttcatttgtggacagggtcttgctatattgcccaagctggtctcgaactctgagcctcaagctatcctcctgccttggcctcccaaagtgctgggagccac

SEQ ID NO: 734557 - DNA, 631 bp, Homo sapiens; identical to SEQ ID NO: 89170

SEQ ID NO: 734558 - DNA, 1464 bp, Homo sapiens
gtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccaggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcc

SEQ ID NO: 734559 - DNA, 1140 bp, Homo sapiens
atgtacttttagctagtttttaatattttataaaacttcatttaaatttgtatttttaacttgaagttccatttcgttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcaatgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgag

SEQ ID NO: 734560 - DNA, 219 bp, Homo sapiens
gccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgta

SEQ ID NO: 734561 - DNA, 37 bp, Homo sapiens
gtgaaggcctctgccaggcatgtgggcagctggacag

SEQ ID NO: 734562 - DNA, 55 bp, Homo sapiens
cttctgccttttgctggtgtttctggaatttgctttccctcacctctcacttcct

SEQ ID NO: 734563 - DNA, 91 bp, Homo sapiens
atacactggaattcgcaataaatccagtatggtggttatagatgtaaaaatgctatcaggatttactccaaccatgtcatccattgaagag

SEQ ID NO: 734564 - DNA, 953 bp, Homo sapiens
cctcattagcacacagatttttaaaaatcaattctcttgccatgcctcctatgtgttcacatctctgcatacactacagatataagtgcataatcattcatataaacatctggtaggtattctgtaaaactgtgtttactttagtgcatgttattgtcatgttatgatgtgactggggtgtttctttgtcatgaaactttgcttcttcacagaattagaatactgctctctctatattgaactacatatacagcgttttcttgtatcagcccccaaagtctggatgcccggtgttgtgtttacatgtgattgtgcctaggagtctgttcacatagagacacctgtaagtatttattacaaaacggaatgtaagcaaatatatccacattggttttatttgaatcaaggtgtttttttgttttttgttttttttccttttgaggaggaacagggagcctcctcctccatgagcacttacagaattgtgtaaaattctgtgaaacagtggtaagcatgggcacccgatttcagctgtcctgctgccgctgccctccaacctgctctgtgtgtgtgtgtcgctgtgcttggtggcagtgtgccgtgctcgtgccggctcttcccagcagactggtatctggctgtaacgtttgacgtcttcatattgccagtctgtattgaggggtgatgtacatggccatacagccaaatgggtctgtgtaccagtgtggggattccaagaacactgcctgtcccccacagcaaatattgatgctgttggtcagccaaagattttcctctcctttgctgcttaaacttgtgccttaatattgtacataataaatggataaaatggcaaaatgactcttttctctcgcttgctcctttcttccttaaagaacttataaactgatgctcaataaatgtttcatttcattgtaccccacttaatgttt

SEQ ID NO: 734565 - DNA, 144 bp, Homo sapiens
aaaaatttaatgttaaaaaaaaactatagacattgacatggaaaagagatttaatgttttgaaaaaaaactttatattaactgagtaacatcctcctgatgagaagtactatattaaatataaacccattatgttataagttaa

SEQ ID NO: 734566 - DNA, 628 bp, Homo sapiens
ggaggtgggactaggggcactttgggggtctccttttagtcaaaagcgagaaaatgacaagaaagagattaaaattcaatgtttcctttatagtgttaaacactaaaattttaaaaaagatgaaaaagaaaaaaaaactttgtaaaatgcgagaacagaagcaaaagacactacgctctgtcattttatctttcttttgttgaaagactaaaaaaaaactgaaatgttttttagacaatcaaatgttaggtaagtgcaaaaacttgttttttcttactggtgtagaaattaatgcctttttttatttttcagttattttataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattggatgtaattgcatacaaagcttgcatctcaatccttgaaagtctagtattaaatggaaaaaacttttcctaa

SEQ ID NO: 734567 - DNA, 2122 bp, Homo sapiens
cgcttcaaggttcacacgccgcgtggcagctcggatgcagcccggttccgaggcggtcggcggtcgagactggggcctcgagccgagaagcgaagaacaaagcggccgcgttagcccgccgccccgagggacagcccgggcgcgcccgccgctccgcccacaccccgcccctcggccgcgcgaaatggcggcggccgcaccacaaaatggcagtcgctcggtcgcggagaagcacctgctaaatgccgtgactccctccccctgccctgccccgctagcgccaacgtcgttctccccgcccaggcgccccggtcttcccacgccgccccgcccaggggcaacagggtccggagcccgccaacaacgcggcgcctttgtgcgggcgcacgccacctttactcagccacacgggcccctctccggggggctttttcttaaaggggcaaccgctggaagaaacggagcaccgccgcccgggacgcccctcaggcccggggttactacggtttccccaactcgcagcgttagcgtcaggccaccaaagtgaagatgggtggtgaaaggaccacagagcccgataggagagaaaacctaggaaaaattagtgaaagacgcccccaaccaatgctttggcggccacgctgagtcctaacgtactgagcccactcgacggggcccgtgcgcacaggcggctccaaagggcgggtttcggctttccttccacctcgcaaaagtccagtgagcgctctaggtttctcatggctaccccctgccctctccccgtgctggggagtctcgggggctgagcagtggcagagggaggagcgctgccgcggtccctgtgctttttctctggcgtgagggtctcagtggccttgggctctgcttgggccgtggctcgaaggttggaggtgtcgcggtgcgcttgggttttttcgctttctttcaaacgcttgcttcctggcgctccccaccccccagcgtccctttggctccatctttccagaaacttctctgagaaactcagcaaaaagcatccaatttcgccactgcttccccctccgcgcatgcgcgagacgccaagcggaaagcctttggcgcgccggagtgtgagagtggtgcgtgagcgcgcgcgcgctcgccgtgcgggggcggttctctctgacaatgaagggaaagaattccccctcccctcaacattccgtcctcgcgcaagcgcgtcggagccacttccttggcctttgagggaagggggaggggtcgtcccgaagcgcgctagtcgtgtttccgcgcgcctgcgcacggggccgttttcgtctcgctgtgttgtccgcgagtctttgctgtgaagtgcgtctgaacagctcgcttgtgcccgacctactttttccttaaggcccactcgcggaaactagtttcttgtggggttatcgattctgtaccccgagtttcctggagattagtctcccctttgtgccccggggatgaggctggacggcgtcgcgctggcttgtcttccaccccttcccgcgccatgtttggaacggctgttgactggatcccgtgtggagtgtgatggagccttctcgaaacgggaaaacagtcctggccgaaggcttgggtggtgcctgggccggcttatattaggcactgcgtagaatgtttgctcactaagcccaaagaaaggtgtctcttttttttttttttttttgagacgggagtctcttgtcatccaggctgtagtgcagtggcgcagtctcggctcactgcaaccttcgcctcccgggttcaagcgattctcctgcctcagcctcccatgtagctgggactacaggcgcccgccaatacgctcgggtaatttttgtatgtttagtagagatgggtttcaccatgttggtcaggctggtctcgaactcctgagctcaggtgatccgcccacctcggcctcccaaagtgctggaattacaggcgtgagccaccgagcccggctttgcccccagcctgggaacggggtcttgctgtgttgcccaactgttttggaagtcctgacgtcaagagatccttccgccagggccttccaaagtgctgagattacaggtgtgagccgccacgcccggccttt

SEQ ID NO: 734568 - DNA, 1449 bp, Homo sapiens
cagggacctgagctttgctacccaaccagattcctcatagagattcctaatcactagtttcttgtattcataaactcagagatacagagggcttggtttgaagttggggtgagatgaaacctttgctctgagccaaagctctggggccttgcattccctgcattgggttgatgactgtcagcatcactgccgcaggccatgcttgactaaggtacctggttttagccacagccacctccttgtatgttacctttcagctctggccaagagtgggacagggttttaaccacaaataggagcagcatgcaattcctagtgacttgctgcacagtattgtatcataattacaggaagtttttatttttaaaactggatctggggtatattcatttgccccatcacctctgtctaaaggcccaagtcctagggctgccatggtcacaagcacactgatgctccttaagattgtttatctggagcccacatagtgtggaacaaaaagtcacctagaaagcatccttggtcatcattgtctccttcccacctggcccagagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacgctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatcagtaaaaaaaa

SEQ ID NO: 734569 - DNA, 179 bp, Homo sapiens
tcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttc

SEQ ID NO: 734570 - DNA, 476 bp, Homo sapiens
gtctgtaaggtcattgtttgccagtcgtgggcagcgcggcaaacctgctgggaaaaggttttctggttggaataggatgagtaccgcaccagctttgccttccagctgagatgtaaatttcaggcctccatcctgtggaacgtgggaaaactatcttgagtgttggcatgttctaagtatgacataatagtttaatgtatgataaatcatgggtgtttagacgaaagatttacacatataaattggaggctttagcggtcttagtgtaactaacttttcgtccccttaacccttgatgcctgttctatgggtctctagagcggaaggagcattatactccggaaacatttgctggaaggggttatgagaaattcctctctgtatgctaactccgtaatacaagcgtttgtgtattttaaaatcacagctgttccaaatataatctagcctcgttttccccctccgtcggatgatag

SEQ ID NO: 734571 - DNA, 85 bp, Homo sapiens
atccgcagagatgcccctgctggccgcaaagtgggtctcattgctgcccgccggactggacgtctccggggaaccaagactgtgc

SEQ ID NO: 734572 - DNA, 954 bp, Homo sapiens
cgtatagagaaatccagatttcaattaattcatttattgggtgctaacaaaattcagggttagagtaaatttaggtctgttggtccatgtggcctggtttcctagcacccattaaacataatgctatcttttaagcctgaacatgtgggttttttaaatcaaattggaaaaaaattagacaactgatgtcatgctgtcttggtatccatactaaaaaagtatcaggaaaatagattatttttgtgctgtgaaacactattcagtggaaagtttagtggcaacttttccatatcattcatgacttaatacctgaaatgcacttttaaatgtttgccttatatccaagtgtttacttgtatccatgacctaaccgtctattgaaaagaatgtttgcagatgcagattgcaatgttgtttgtattcataggcaaaagtcctcttctctagtataattttttaaatctgagagaattgaaggtacagaaaaaaattctggagtgcctgaaccacagtttgagagcacaaaggtcacattctttcagtaaatttgggggaaataaatttcagctacctggttagcttcagtgactacttacacacagggctttggttccattacttgtttccaccacagccacatcctaaatacttggaatatccgaaaacaacttctaaaatcactcaataaaagtattcacttctaaccaactcctcctcctttatacctgctctgtgttagggcgtagtctgtttccacctctgtaagtcctatctaggcttcctgatctatcaattcagtatcatgattgttaacccaaacgacttcctggaaaattcccagccctagatgtatccaagccctcctaccctcaccagttatttctggagaaagatcaccaaatgtataaatccgtattagtaaaaattggttttaactgacctcagcactgccca

SEQ ID NO: 734573 - DNA, 1370 bp, Homo sapiens
ggtgcggcccggctcagcgctggcggccgctgtagcgcccccggagccggctgagcccgtgcgagacgtgagctgggacgagaagggcatgacgtgggaggtatacggcgccgccatggaggtggaggtgctgggcatggccatccagaagcatctggagcgacagatcgaggagcacggccgccaaggggcgcccgcgccgccgcccgccgcccgtgccggccccggccgttcgggctcggtgcgcaccgcgcccccagatggcgccgccaagcgtccgcccggcctgttccgcgcgctgctgcagagtgtgcgccggccgcggtgctgctcgcgggcgggacccacggccgagtgatctgcccccattttgtacgcccgagtttccgaccttctcaggctcccttcttgatcacaggcccctagaaggggtcccctctgcgtgccacaggcctccgaggggttgtgcagcctctagggctgttgcgtccccgtctttccagcccctcccatcacaaatacagaagaaccccttctaccaagctccctcgtggccacgaggccacgaacccggccagccctgacgccccactgtcccctcacagccctcagctctactcccggtcacactgggcgaccacgggggcctgctcagcaccctcacctcccaccccctgagagctggggcaggctcctgagatgtctagactggtgcgttgtggtctccggtggggccagatccccagaacagggagagactgcatacaagtctgagtggcagaagcttcaagtgggtgaggatcggtgtgtgagacccgcgagtgggcacgtctctgaatgtgaggtctcgggcagcacgtgaggtagaacgagtgtgagcgtctccacgcagtggctggccccgtggccggggcgtctcttgcatgctgttggtggtccttccccagttcctatctcccacccgcctggttccagccccatcccctctcccactgagtcacaggtttgagattcccagagaggccaaagacagctacaggaagtaccctgggggctcagctgagagagagtcacagaaaggccagagggtctcaggaaggtctggaggtcacagctgggctcacagaagctcttgggccctggcatcctgggtgaccggtgttcttgggtattggggacaggacagagagctcattctataaccacagttgtcttttaaaggccaccctctccagccccttgtcccccctgtgctgtgagcccaagtcccttgtgaccactcagtgtcccgtccccacccctccagccgcagtttttggctacaaactgtcacagtatacattggtaataaaatatttccccaaaaactg

SEQ ID NO: 734574 - DNA, 328 bp, Homo sapiens
atggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggagg

SEQ ID NO: 734575 - DNA, 212 bp, Homo sapiens
tggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccag

SEQ ID NO: 734576 - DNA, 920 bp, Homo sapiens
atgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataat

SEQ ID NO: 734577 - DNA, 1839 bp, Homo sapiens
tgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcct

SEQ ID NO: 734578 - DNA, 1791 bp, Homo sapiens
acatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccgccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctaaaaacatctg

SEQ ID NO: 734579 - DNA, 416 bp, Homo sapiens
gctgtgtttgagatgaaataagaggttgtgggtagaggggaggcacctaaaggaaaagaggaaaggtgcctgggctacctatgcagataacctggagtggacttcactgtggactcgtggtactaaggcttggcctggacaggcagtctagggggtatgggaatacacggtgtggttgttcaactatttgcaaaggtcaaccaaatagaccacatgttcgcaaagtatcatctgaggaaattaagtaccttcttagccctctcagtcataaatttgaacaaattttaatacacttccctcatgcccttctatataaaacttaataccattagttccccattcttgacattttatttcagtttttattatatatttatttgaaatatttattaaattatctgacctacagaactaaa

SEQ ID NO: 734580 - DNA, 54 bp, Homo sapiens
gtctgctgtgcacgtgctgcagaactccatagacagcctcactttgtgctcggg

SEQ ID NO: 734581 - DNA, 143 bp, Homo sapiens
gtggcctgctacagctgcacgtctggacagtggtcatctgtctgcccactccctgctgggcacggtgagcctggcattgctgtgctggacaacaggatctatgtgttaggtggccgctcacacaaccgcggcagccgcacagg

SEQ ID NO: 734582 - DNA, 1500 bp, Homo sapiens
ttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatattggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaatctaaatgtattcagttgacaaaatggacacataagggctttttctaaataccgtacataattacacattttcacacttagagggtaatcctatgatacactgtcaatctctattttaaaagactatcaccagaaaagagagaaaagaaaattcatataagaaaaagaaaatgtgaaaaagatcataggcttgggaattccctcaaatccagaaaattccaggttaaggcttgaagttgaatcattcccaggtctagctctaaggttaacaagagtacaaggcaaacaatttctttggggacaagcagcattatttcaattagaccttctcctgcagggcaaaaatcattcttccccacactatgaatggactccaagtatcataataagcaggtaaactcacaagaaccaaagctgacatatggataaaagcagcaagatcacagtacaccaaagtatcatatatatagaagaaataattcaatgtcttagatttgtctataaaaatttgtgatctatataggacttcattcacatggacactaacgataaggagtatttgctttggcggtagtggatcacacatctgcttatcttgctttgatattttttacataatgtttctgagtgatacagatgtgagtcaggtagcatttgatttccccacatatacacaactgaggtgccctgccattggcatcccctgggatccttgattcactgacgttagccatacgaatccagtgttcaaactcagaataataagcttagtttctgcattatcagtcagcataaataataaatccagaaaacgtgctgta

SEQ ID NO: 734583 - DNA, 418 bp, Homo sapiens
gatgggacgtggagaagggaaatgctggagggatccagccagacttgctcatctccctcacagcccccaaaaaatctgcaacccagtttaccggtcgctaccattacctggggggtcgttttgtgccacctgctctggaaaagaagtaccagctgaacctgccaccctaccctgacactgagtgtgtctatcgtctgcagtgagggaaggtgggtgggtattctccccaataaagacttagagcccctctcttccagaactgtggattcctgggagctcctctggcaataaaagtcagtgaatggtggaagtcagagagcaaccctggggattgggtgccatctctctaggggtaacacaaagggcaagaggttgctatggtatttggaaacaatgaaaatggactgttagatgccaa

SEQ ID NO: 734584 - DNA, 175 bp, Homo sapiens
ggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgt

SEQ ID NO: 734585 - DNA, 221 bp, Homo sapiens
caaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaat

SEQ ID NO: 734586 - DNA, 1114 bp, Homo sapiens
agactgtcaaatgaacttttacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctgaaacctggctgtccccactcactgtctttacatctagaagagcccctgtgagctctcgcttagctggccgggcggggggtggtgggggggg

SEQ ID NO: 734587 - DNA, 167 bp, Homo sapiens
aaaagtgaatcggggtgcggagagtgggaaccttttgaatttatgattgtcacagagatggtagaaattatgatctgactggaaaacaatcctgtatcccctcccaaagaatcatgggctttttttttgaattaaaaagcagacaaatagactttctcgggatttca

SEQ ID NO: 734588 - DNA, 67 bp, Homo sapiens
gtaaggggcctggataccaagaagtgactgctcatctaatccataaagctatgttaacagattggag

SEQ ID NO: 734589 - DNA, 281 bp, Homo sapiens
aataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 734590 - DNA, 195 bp, Homo sapiens
ggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgac

SEQ ID NO: 734591 - DNA, 946 bp, Homo sapiens
tttttttttcttgaatgtgcttcgcaagccaggctatcttccaaggaaggcagacagtgggagagcagagggactgactgcaggcaagcacattgaagaaagacactggcgggtttccccaccctcaccccaaagcagaaaactagcagacgtcagctcagccccgtcctgggcacagacactacacaaggagacgctggaagttaagcaatactttaatactgtaatatgtttgttttctttttctttcttttttttctaccaaaaaaaagtaagtaaactaaaacacaaaaacatataaataaaatccatccctcttgtcggggacctgcaggggggcaaccttaatccaaacacctggctatcaaataatcagaatgtattgtctcagacaggatttcagttccgggaggcaggggcatgatgggggagggggccggaggctgagagacaaaagttccagagcctccctcgaaggttctctactactgtattctgtacataatgtaccatcccatgtggaatctgtgagtgtcctcttaagtagcgtgggctagccaatctgccgttcatggtgtattgtaaactccgaattccatatgtaataggatgcaagtctaagcgtttcatgtggacataaatgtatctaaataaaactttccctagcactgtggctgacctcacccttacttttatactttagtatgaaactgatgagaactttggtagtgagtattttttttatatatatacatatatatgtactatctatatatatatctcaagcatctttcaggtctttgtgtgtggctttcttaaagccctgttgtaaaaaattactatgtggatggcagtctctcacatcacagatgtggaaagtataattttatatttgtattttcaaataaataagtttgtgaaaggtttccatcctctactgtggtcc

SEQ ID NO: 734592 - DNA, 559 bp, Homo sapiens
tagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcaataaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcattaaaaaaaaaa

SEQ ID NO: 734593 - DNA, 160 bp, Homo sapiens
gtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctg

SEQ ID NO: 734594 - DNA, 201 bp, Homo sapiens
tggaagattttataaaagaatttttgtgggtcggggggacagtaaacttcctgggccacgtgggtccttcaggagtttttcaggcaagtttttcctctgtttttaatatataactataatatatatgaatagataaatataactaatgtgcgtgagaatgggcctggcacacctggggtgctcgggggtagggctgccatg

SEQ ID NO: 734595 - DNA, 2970 bp, Homo sapiens
ccccaaatccagtgaaagaaattctcccagtaaaagttgcttcctaactctgtttttctcagaatacctcttacctttctcaaagaaagcttcaaccaccatcatcagaaagaaggtggcctaaaaactgacacatggccagtgcccggaggggtctggaggcataagtctagatgcccagagagcatccaggcactgaactgctcagagcttgagatgaaatgacatacaagcttcagggtaaaactgtctactagcaagattacctccctcaattctaccattgcagatttcttctgaccccaaatgcaaccttacagagaatgctgaatgaggaaggccaattccttacaatgatggcagaacccccaagcgaatgccctattgaggagaaggacatcactgtatttggaattctgcctgctagtgatagctcacacatcacatcccagaatcccactcccaatgcattatttcctgaggcaagaacttaaggtcctcacctaattcctccatcacaaccattaactcttattggacaagctcctcctgtgagtggggcctgtactcacttcctcttagatcataattccatcttcaagagactgatttccagaatagtaatctttttccagcgttctctcttctccaatgccctggttgttatttttcccacctctcctaatattgatcttcttgtcttttggttagaactgcaacttcggagttgagttcatttcctattgctgctcaattcagtagcaacatagctggcttgttcccagacccaggaagtataagtcattgacagtttcctgagtggctcttgcaatccataccacccttggtactgtgaaaaggcttcttggcagccaggtggcattgaggatggtattcagggcgctttccttctgtcatatagttgtgggatctctaccaagtgtgaaggtgaatgaggtaagggagatcagaaccatgcttcctggtttttcatacatccaaggaagaagtcctggtgtgggttgtttgacaccttctttccactttcaccttttattttttattccttcctttctacccccaaccagtcgagcaaatgagcaattttgtgtttctaatacaggatctggaagtagtgctttctaatcctcatttcctgtaggatgttcctgcactataacaagattatgttttcttccttctgcagcagctttctgcttcttgggtactactagctattgttcaattcaggtgaggcctgtgatgacatatatgtagcatgtgctctgcgctccctgcaagctgagcagatacaaccaatgcatcactgtatactcttgctgagaatgtggatgcagcctcacagatctttgcaacactccaaccagccaggaccagttgatcagaactgatcttattggtctgataaccaatcttatttgtgaactgattcatatctgtctttccactcttggttctcttgccgtagaacaaaaacagtttaggaagcataattacgaacatttaggaaccaatatgtataagtaattcggagactccaattcacctgcccctcccccatcccaggttgtggaggctcgaggaagctgacttcttaggctaaaggacaaaaaaatctctttacctccttggccattttcatgttctctgccaattactataggcagtcttcattttgcagaggtgaggtaagacttcatcttattcttcatgtaatcccaccttctaacaaaaaataaataaatatttaaattccaaggagaagtgttctttgtgtatttctagcagaaaacagatgcttaagcctaagaaggaagatccgtccatgacaaaggaaagtggaaaactgaaccagttatctgaatacttcatgccaggacagttgctattagcaactgttttgcaccttcagggctttaaaatgggctctgcagacagcatttgcatatgcaagactcagtagccaagcctccactgccaattgttgaaggcagtttcagatcgccaccttttgaggtacatttctttaagcacaagagaagtagaaatggcctttgccttgtctccagtggtttgtccctctggtgcctcagcagataccagagcttattcttatgaccatttggaagtagtcctcaaagtaaagatcaagaaaaaattggattctttttccattttctcataatagtagcctagtcaacacaagactcccataaaatatgactcactattgggagccatactattttataagcttacttcctgctgacaaaactagctttcctcaaggaaatataaaggaggggaaagtcacatagtgttaggaaaacattcctgtgttttgaatacgatgaatccataggatagagaaaaatctgcttgttctattctgagagttctctgagatatcccttcactctgcttggcatttggccattgatattcaacaggtcactgaccaagcttttctaaatttttcagagagagttacttaccaataaggtctgttcttaaacctacctagttgattttcatatctttccataaagtgtcatgattctatcatagaccctgacttaacattgtaaggactatgagtcctccattttttaattaatttttttttagcaaattaggacttcggcaggttttcctctcctaaactcattctttcctccacaggattgctttgtccatctcctgctttcatttcaagtgcataaacaaaacctcaaagggcctgggaaggtgaggcaggccagagtctgtgttctgtgttgagtgtcaagctatttgttaagaaggtctgcaacaggcctttggtgtgggctctgccagagactgttctgaacactttgcttgagatccgtgccctgtaaaatggatatgatgttttactgatgtctgtaatacatttgtaaacttccaataaaatttgaataaaagaaa

SEQ ID NO: 734596 - DNA, 71 bp, Homo sapiens
aggatgatgagtttacacacctgtacacactgattgtgcggccagacaacacctatgaggtgaagattgac

SEQ ID NO: 734597 - DNA, 142 bp, Homo sapiens
gccacccgggaccttgcccagtacgacgcagcccatcatgaagagttcaagcgctacgagatgcttaaggaacacgagagacggcgttatctggagtcactgggagaggagcagagaaaggaggcggagaggaagctggaag

SEQ ID NO: 734598 - DNA, 31 bp, Homo sapiens
gagatgcgcaaattcactccccagtacaaag

SEQ ID NO: 734599 - DNA, 405 bp, Homo sapiens
catttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaag

SEQ ID NO: 734600 - DNA, 488 bp, Homo sapiens
gtaatttatggttttcattttatttaaaattcagcaaaatcatacgccatctaccgtgatgactgccaactccatggcagaccctttctgggattcaaaaaccaattcatcagatcgctgcctctgagggatgtacagattggctggggagctgagtgctacaataaaggaggaagtaccggggaacagtgcagggcaaaggcaggaaagagatctgagctgcctggagatcatctggggtgcggagtacaaagctttgcaagggtgtggttttggaatgacgctaaactgaaggtggagagaacagataaaaaggttggaagttgcacactgtacactgttaagaagttgagcttttatcttagaggcagcagaaggtttggagccaaggaatgaaatgatgaggcgtccttcaggtaatgaacttcagctgcagtgtgaaaggggcaggaagactggcagctgtcaaaactggaacagtccagtga

SEQ ID NO: 734601 - DNA, 69 bp, Homo sapiens
gttggttcattattgaatgtgctgtaaattaagtcgtttgcaattaaaacaaggtttgcccacatccaa

SEQ ID NO: 734602 - DNA, 240 bp, Homo sapiens
tttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatc

SEQ ID NO: 734603 - DNA, 33 bp, Homo sapiens
ccgctgctcactttccaccctctctccacctgc

SEQ ID NO: 734604 - DNA, 98 bp, Homo sapiens
ctatgtcctaaggacacactaatcgaactatgaactacaaagcttctatcccaggaggtggctatggccacccgttctgctggcctggatctccccac

SEQ ID NO: 734605 - DNA, 34 bp, Homo sapiens
acagctcgaagagcacctcctccttcccctgccc

SEQ ID NO: 734606 - DNA, 149 bp, Homo sapiens
gcctccactgaggcacctctctgggaataacgttccccagcaccccaaatggatttccagtcaattcagaagcattttaccagtgaagccctcattattccagttcactgttaaagccagtaattctctatattaaactttccctgttc

SEQ ID NO: 734607 - DNA, 99 bp, Homo sapiens
agtagcacagaagagggaggatgctgtttccaaagaagtgactcgaaaactttctgaagctgataatagaaagatgtctcggaaggagaaagatgaaag

SEQ ID NO: 734608 - DNA, 104 bp, Homo sapiens
gatgaccggaaagaagggatgaccgcgtttgtggaaaagagaaaggccaacttcaaagaccagtgagaaccagctgcccctgcttcacacctctgcttggagag

SEQ ID NO: 734609 - DNA, 50 bp, Homo sapiens
agcggtggttgatggcgccttcaaagaggtgaagctgtcggactacaaag

SEQ ID NO: 734610 - DNA, 81 bp, Homo sapiens
gcactgggcttcctgacctaagcagtatgactgaggaagagcagattgcttatgccatgcagatgtccctgcagggagcag

SEQ ID NO: 734611 - DNA, 62 bp, Homo sapiens
ccaagtacaagtgcaaattaactgccgtggtcaagtgtgtcagtgactgcacattggtttct

SEQ ID NO: 734612 - DNA, 258 bp, Homo sapiens
aagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataata

SEQ ID NO: 734613 - DNA, 153 bp, Homo sapiens
gttcatggatcaacatccggagatggatttttccaaggctaaattcaactagcccctgttttttcctccctgaactcttggggctgagctgcaaccacccaactttctttcccactcttctctgggacttgtgggcctcagggcttggggcag

SEQ ID NO: 734614 - DNA, 130 bp, Homo sapiens
gtgctggagctggcaggtaatgcttctaaggatctcaaagtaaagcgtatcactccgcgtcacttgcagcttgcaatccgtggtgatgaagagttggattctcttatcaaggctaccatagctgggggtg

SEQ ID NO: 734615 - DNA, 51 bp, Homo sapiens
gtgggcgtggacttcactggctccaatggagacccctcctcacctgactcc

SEQ ID NO: 734616 - DNA, 37 bp, Homo sapiens
acacataaacctttttaaaaatagacactccccgaag

SEQ ID NO: 734617 - DNA, 31 bp, Homo sapiens
gtggccaataatcaagacaaactgggatttg

SEQ ID NO: 734618 - DNA, 632 bp, Homo sapiens
gaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaaagctgcatacttgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatga

SEQ ID NO: 734619 - DNA, 545 bp, Homo sapiens
gtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccct

SEQ ID NO: 734620 - DNA, 33 bp, Homo sapiens
gtggtggccaagctctcaccagccaaccagcgg

SEQ ID NO: 734621 - DNA, 29 bp, Homo sapiens
tctcctataaatgtaaatgggtcacgctc

SEQ ID NO: 734622 - DNA, 226 bp, Homo sapiens
ggccgcatcatcgagtgcacacactgtggctgtcgtggctgctctggctgaggctggcgcgctccaccctggactctggacttcgcaggttcctgcctgtcacgccacccccttcctgggagcagcgagcagtgccccaggcccgagttggagcacggtctctatggggaaggcttcgctgtctatcagctgtgatttgtaaaaataaaatctttaaatctctcga

SEQ ID NO: 734623 - DNA, 172 bp, Homo sapiens
gtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagccc

SEQ ID NO: 734624 - DNA, 125 bp, Homo sapiens
atgacctttactgtgttagctctttgaatgttcttgaaattttagactttctttgtaaacaaatgatatgtccttatcattgtataaaagctgttatgtgcaacagtgtggagattccttgtctg

SEQ ID NO: 734625 - DNA, 214 bp, Homo sapiens
gtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggag

SEQ ID NO: 734626 - DNA, 258 bp, Homo sapiens
aacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtg

SEQ ID NO: 734627 - DNA, 130 bp, Homo sapiens
tgggctcgtgggttggcagtatgagagttgtaatggcccgactgttgagtgagggggagcaggggatcccaacggcttgcgctgcctttgcgcagcagccggcgggcggccacgtcgcggcctggctggg

SEQ ID NO: 734628 - DNA, 191 bp, Homo sapiens
tgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagattt

SEQ ID NO: 734629 - DNA, 332 bp, Homo sapiens
acgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaatg

SEQ ID NO: 734630 - DNA, 30 bp, Homo sapiens
atgttgggtgtccatcctggggcagggaag

SEQ ID NO: 734631 - DNA, 357 bp, Homo sapiens
ctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtccccccccttttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgc

SEQ ID NO: 734632 - DNA, 485 bp, Homo sapiens
tgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggag

SEQ ID NO: 734633 - DNA, 306 bp, Homo sapiens
tcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaag

SEQ ID NO: 734634 - DNA, 81 bp, Homo sapiens
ggcctgaaggccaggaggagtcaactccgcaatcagatgttacagaggatggtgagagccctgaagatccctcagggacag

SEQ ID NO: 734635 - DNA, 155 bp, Homo sapiens
ctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 734636 - DNA, 105 bp, Homo sapiens
ggaccgtaagaagaagcggtttgtgggacagtcaggacaggaagacaagaagaagattaagacagagagcggccgctacatcagcagctcctacaagcgagacct

SEQ ID NO: 734637 - DNA, 45 bp, Homo sapiens
tatttggaataataaagcaggaacttttcctgaagttgcaattta

SEQ ID NO: 734638 - DNA, 100 bp, Homo sapiens
tatctcagagatgttaactgtcctttcaagattcaagatcgacaagaagctattgactggcttcttggtttagctgttagacttgaatatggagataatg

SEQ ID NO: 734639 - DNA, 246 bp, Homo sapiens
attcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatc

SEQ ID NO: 734640 - DNA, 118 bp, Homo sapiens
atttggcagagagtgatttggcatatacccgggccatcatgggcagtggcaaagaagattacactggcaaagatgtactcattctgggaggtggagacggaggcatattgtgtgaaat

SEQ ID NO: 734641 - DNA, 71 bp, Homo sapiens
aggcttgctatacttggtctgcttcaaggaggtcgaccttctaatgtatgaagaatgggatgcatttgatc

SEQ ID NO: 734642 - DNA, 446 bp, Homo sapiens
tacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattga

SEQ ID NO: 734643 - DNA, 37 bp, Homo sapiens
ttatttttagcctagatctaaccattttcatactctt

SEQ ID NO: 734644 - DNA, 148 bp, Homo sapiens
gtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaa

SEQ ID NO: 734645 - DNA, 130 bp, Homo sapiens
gtatccctgttgatccgccgggagctgacagagagggccaaggacttcagcctcatcctggatgatgtggccatcacagagctgagctttagccgagagtacacagctgctgtagaagccaaacaagtgg

SEQ ID NO: 734646 - DNA, 346 bp, Homo sapiens
cttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgct

SEQ ID NO: 734647 - DNA, 2008 bp, Homo sapiens
acctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgattttttttttttttaaagcaaacttgtcctttggttttgcagaacaggcctgctccctctcatctagcccaccatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatcttcggtttctgataacccctgggtccatctggccatcagcctcagcagtgagcaaagcaataccatactcatttctatgttcctgttccttcctctgctcctcctttggagaagcaataattcatgggggatgatacagtagcactttacaaatggctccatgtcattcatcccaggggccataatctcttgcaccacctattcttacttcctgttcagctcctttacagctttt

SEQ ID NO: 734648 - DNA, 43 bp, Homo sapiens
cgcctgtagaagagagcacagcatatgttcccaaggcctgagt

SEQ ID NO: 734649 - DNA, 443 bp, Homo sapiens
ttctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactatatatagtaggagggggtatgtgtctcaggcttttctgaagttgcaagacttaaagaaataatccatctgcatcccaagtcctattttataaggatattcataaaaattccatggtgaatccttgtctgaaataggtcctcccttcccagtttctgtgtaagtctttgcatttaagacatccaatcaataatgaaggaaatttttttctgaatgtaggtttgagtgaggggcacctctgctttcccttagcaaccctcatatac

SEQ ID NO: 734650 - DNA, 301 bp, Homo sapiens
agaggagcatttggcctcctgcttccttctgtggcctctgccgggctccattcccaaggaaaagagaggagcttgggctcacagaaagagaaggggatgaaaccccaaggggccctatctttgggatttacatggaattttattttctacaagtttgaccttagccatggtttgcaagtgaacagaacattctgacctctgtcttgctctgctcctttcatcctcgtctcccctgccccgtctggtgcttacattctgaatatatgtcatctcccaagaggcttcactgcctctgcttcca

SEQ ID NO: 734651 - DNA, 45 bp, Homo sapiens
gctgaaggggatgctaagggagataaagcaaaggtgaaggacgaa

SEQ ID NO: 734652 - DNA, 25 bp, Homo sapiens
cgccacggagcaggccgccacccag

SEQ ID NO: 734653 - DNA, 60 bp, Homo sapiens
tgtctacccctgagctggctgcccaatctgatttcatcgtcgtggcctgctccttaacac

SEQ ID NO: 734654 - DNA, 95 bp, Homo sapiens
aaaatgttctatttaacaactgggtcatgtgcatctggtgtaggaagttttttctaccataagtgacaccaataaatgtttgttatttacactgg

SEQ ID NO: 734655 - DNA, 122 bp, Homo sapiens
gtcttgatcttagcagtcaaatcaagggctgtctcgtgactgcttcagctgacaaatacgtgaagatctgggacatcttaggagataggccaagtctagttcattctagggacatgaaaatg

SEQ ID NO: 734656 - DNA, 111 bp, Homo sapiens
aagtcgcttagctcttcggtggttgtcacacgtccggaggcctagccgtcgcgtacctaggatgccgcgtggaagccgaagccgcacctcccgcatggcccctccggccag

SEQ ID NO: 734657 - DNA, 121 bp, Homo sapiens
ccccacctgatgagccaggagctgccggaggactgggacaagcagcctgtcaaggtgcttgttgggaagaactttgaagacgtggcttttgatgagaaaaaaaacgtctttgtggagttct

SEQ ID NO: 734658 - DNA, 88 bp, Homo sapiens
ttacagaatgtctgaaggggacagtgtgggagaatccgtccatgggaaaccttcggtggtgtacagatttttcacaagacttggacag

SEQ ID NO: 734659 - DNA, 84 bp, Homo sapiens
ggtatctgcttcatccggaccagccgcccagaaaatgccatcatctataacaacaatgaggacttccaggtcggacaagccaag

SEQ ID NO: 734660 - DNA, 27 bp, Homo sapiens
cctgggggtctcagggagaacctttca

SEQ ID NO: 734661 - DNA, 101 bp, Homo sapiens
gcccgtggaaaggatgcatccccatctgtccaaaggctatgcgtacgtagagtttgagaatccagatgaagccgagaaggcgctgaagcacatggatggag

SEQ ID NO: 734662 - DNA, 1013 bp, Homo sapiens
ggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgt

SEQ ID NO: 734663 - DNA, 687 bp, Homo sapiens
taatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacacc

SEQ ID NO: 734664 - DNA, 21 bp, Homo sapiens
gccccagcgcctcagccccag

SEQ ID NO: 734665 - DNA, 238 bp, Homo sapiens
tgccccctctttgtagctcctataaagggcccacacctggtggatacctggttgagcgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggtt

SEQ ID NO: 734666 - DNA, 36 bp, Homo sapiens
gtagaggaagaagaagaagaaaagaaaccaaagact

SEQ ID NO: 734667 - DNA, 71 bp, Homo sapiens
ctcgtggccatcggtgtctggcagatgcggcacctcaagagcttctttgaagccaagaagcttgtgtagct

SEQ ID NO: 734668 - DNA, 173 bp, Homo sapiens
attctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatag

SEQ ID NO: 734669 - DNA, 113 bp, Homo sapiens
gagactataaatattcaggaagagatagtttgatttttttggttgatgcctccaaggctatgtttgaatctcagagtgaagatgagttgacaccttttgacatgagcatccag

SEQ ID NO: 734670 - DNA, 222 bp, Homo sapiens
tggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgc

SEQ ID NO: 734671 - DNA, 147 bp, Homo sapiens
ctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatg

SEQ ID NO: 734672 - DNA, 184 bp, Homo sapiens
tgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 734673 - DNA, 105 bp, Homo sapiens
tgacttgtgccagcagcatggactgcgtgcctctccgccggaggtctagctgtgggcggccaagaagggtcacccttgaggacaaacctctgtgcaggaccttgg

SEQ ID NO: 734674 - DNA, 297 bp, Homo sapiens
atgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 734675 - DNA, 261 bp, Homo sapiens
accaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataa

SEQ ID NO: 734676 - DNA, 748 bp, Homo sapiens
attaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcag

SEQ ID NO: 734677 - DNA, 2884 bp, Homo sapiens
gtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataagacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctcttttt

SEQ ID NO: 734678 - DNA, 690 bp, Homo sapiens
atacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctccc

SEQ ID NO: 734679 - DNA, 98 bp, Homo sapiens
gactccttaaagttccatttgctaatgattaatacactgtttgggctggccagtttttcatgcatgcagcttgacgattgagcacagtcaggcctttg

SEQ ID NO: 734680 - DNA, 83 bp, Homo sapiens
ctcttgaaagcatctgtttgagggaaaggtctctgggcaagcaagtggttatttggattgcttgcttccctttttccacctgg

SEQ ID NO: 734681 - DNA, 66 bp, Homo sapiens
gacccggaggaccctccgtgggcacctggcaaagatctatgccatgcactgggggaccgactcaag

SEQ ID NO: 734682 - DNA, 340 bp, Homo sapiens
cgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagata

SEQ ID NO: 734683 - DNA, 243 bp, Homo sapiens
cattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccct

SEQ ID NO: 734684 - DNA, 33 bp, Homo sapiens
gctttaaggagttttaagctgagtgtcactgta

SEQ ID NO: 734685 - DNA, 161 bp, Homo sapiens
ccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagct

SEQ ID NO: 734686 - DNA, 193 bp, Homo sapiens
gtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgg

SEQ ID NO: 734687 - DNA, 49 bp, Homo sapiens
cttccttctgggactggacagctttgctccgctcccaccgcccccgccc

SEQ ID NO: 734688 - DNA, 37 bp, Homo sapiens
ctctgcaatctgcaaataactcctccattgaaataac

SEQ ID NO: 734689 - DNA, 316 bp, Homo sapiens
tctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggca

SEQ ID NO: 734690 - DNA, 76 bp, Homo sapiens
gctgaaaatatttacaatgatgaagagtcagatgtcacgacatccgaactggagggacaaggatcttaaacccaaa

SEQ ID NO: 734691 - DNA, 193 bp, Homo sapiens
tgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcatag

SEQ ID NO: 734692 - DNA, 25 bp, Homo sapiens
aaatttcaattctcgtggtaatacc

SEQ ID NO: 734693 - DNA, 59 bp, Homo sapiens
gagctccagggactgtcttttctgtattcgctgttcaataaacattgagtgagcacctc

SEQ ID NO: 734694 - DNA, 32 bp, Homo sapiens
gcaagcacctcccagcctgcctttcggagcag

SEQ ID NO: 734695 - DNA, 113 bp, Homo sapiens
ataatcccagatccagctggaaagctgaagtatttcgataaactgaattgagaaatacttcttcaagttatgatgcttgaaagttctcaataaagttcacggtttcattacca

SEQ ID NO: 734696 - DNA, 216 bp, Homo sapiens
tgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaag

SEQ ID NO: 734697 - DNA, 56 bp, Homo sapiens
aaaaactccccttttttgcccacagcttgcctactctcggcctagaagcagttatt

SEQ ID NO: 734698 - DNA, 47 bp, Homo sapiens
aaaaagcctttagtggatatttgggaacagatcaaagtaaatggaag

SEQ ID NO: 734699 - DNA, 33 bp, Homo sapiens
tggacatcggtggtgctgaccaggaattctttg

SEQ ID NO: 734700 - DNA, 128 bp, Homo sapiens
cggctggagcgggagcgcatggagcgggaacggctggagcgcgaacgcatgcacgtggagcacgagcgcaggcgcgagcaggagcgcatccaccgtgagcgcgaggagctgaggcgccagcaggaact

SEQ ID NO: 734701 - DNA, 739 bp, Homo sapiens
aaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggta

SEQ ID NO: 734702 - DNA, 255 bp, Homo sapiens
tgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagcca

SEQ ID NO: 734703 - DNA, 40 bp, Homo sapiens
ctaggttcaggtcagctctgcccctccgcccccctcctgc

SEQ ID NO: 734704 - DNA, 150 bp, Homo sapiens
ggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtac

SEQ ID NO: 734705 - DNA, 165 bp, Homo sapiens
ctgtagtgtaaagtggccactatgaatccctatgtatgagaggagggaggcaggctgcagcttcagccacagaatggggactatggaagacagcaggagctcatttcctctgcacattttggctgttagacctgtgtgtgtgtttaaaaaaagagaagtcagtgc

SEQ ID NO: 734706 - DNA, 80 bp, Homo sapiens
ggcccagatattacactgtcaaaactttacaagttaattgaagagtcttgtccacagctggcaaattcagtgcagatcag

SEQ ID NO: 734707 - DNA, 45 bp, Homo sapiens
catttttttgtgtgtacagcgtcatataggctttgcctttaatga

SEQ ID NO: 734708 - DNA, 2800 bp, Homo sapiens
gccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcag

SEQ ID NO: 734709 - DNA, 1596 bp, Homo sapiens
aaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaa

SEQ ID NO: 734710 - DNA, 70 bp, Homo sapiens
tgaccttggggtccatgtggatggcttcatcgctaatgtagctcacacttttgtggttgatgtagctcag

SEQ ID NO: 734711 - DNA, 65 bp, Homo sapiens
ctgcgggcgatgcccagggcacagtgaaggtgtggcagctgagcacagagttcacggaacaaggg

SEQ ID NO: 734712 - DNA, 101 bp, Homo sapiens
gctctgacagattaccgggcagagctccgggatgacccaatcatcagcacacacttggccaagttgtatgataacttactagaacagaatctgatccgagt

SEQ ID NO: 734713 - DNA, 44 bp, Homo sapiens
tgtaaatacaacagaacattaataaatatctcttgtgtagcacc

SEQ ID NO: 734714 - DNA, 291 bp, Homo sapiens
aagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacat

SEQ ID NO: 734715 - DNA, 51 bp, Homo sapiens
ctccccgttgtcggcggccgcggccaccgccgcctccttctccgctgcggc

SEQ ID NO: 734716 - DNA, 417 bp, Homo sapiens
cctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttg

SEQ ID NO: 734717 - DNA, 1657 bp, Homo sapiens
ttttttgtatgaaacttggaggcttacaggtatagacagctttcagctacagcacattctaattttttattttgtttagttcttttgtattcacttctggtctctttaagactgttttaaaagaaatcaatttagggaaccccagttatataatataaactttgtaatctgagagaaaaaatgtatagtaaatctaagtcttgatttttaactttctattgtaaaaaataataatatacagagtttaatagaaggtgatgttttggttttgttttcccagaggctgccatatggtctttgagtacggggatgtcccaaactggcccaccaatgagcatggcggctccggccaggaatgccagagttagcctcccaggcttgcgggtggacatgcctgctccctgccagcctccagtggcctggccaggccctcccgagcctgtctgccctccccaggggtggaggagtctctgggccccaggaggattccctcccggagactcgcacggtgctccctgctcacgcgttgtcacagttagtccggaaatgactgaaaccaggcattctcccggacctcagcgtgggggagcctccaggcagacgctgggtatggagctgtggtgtggtctgtcctgtatggtggccagtgctttctgccagcatttctggatggatatagggactatcattagtatcctaatacacggtgattttaaaacaaccataaaattgattcagagtccactgacccttacagatgtaggtatacccttactggagagggaactctgatgaggagatgctggtaaattatcattttttaaattgctggtgagtctgacacttggtgagttttcagccagtttgttaaacttttaattaagttttgtttataataaaaatataaatggatttgaaagtttccattttttaaagttaccctcgttttcaaaggtattttctaaacagatctttaatggactatttaaaccgaatttaaggaattcacacacgacagttgacaggtcttcacgcaggctggttggtaacgtgctgccagcacagggctgggtgatacgtacaccctaagccgggggtgcctggggctggggggcgctccttgcaatgcccctccagccacagggcagtgaggtgctgcctgtgtgagccgtcgggggagcggccggctgtgggggcagcgcagcaggagcatcgtggggcctttccttctcggctggttctctgtgacggtggcgtcggctcgcctctgctcctttcatctagaaagaagccactgaccctgacagcccacggcgggtacactgagcagctgcattggtgctgtcacttttttaaggctttctgtccagacttcaacactggtttcttttcagagtttcgaaggattaatgacttcctcagcgcccttgctggcgggctgagggtgacagtcacgtccgtttcttctgtattagaaggctgcggtgattcaattagattgtcccactgctgagacctgtagggcagcttctaacatgcttttttcaaggggagaggagtagtgacaagtcgtgtgtcggaattggatttgagaacactctgaatgacccctggaggccgagggggcaggcttcgggcgtgaactgaactccagacc

SEQ ID NO: 734718 - DNA, 144 bp, Homo sapiens
gctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgag

SEQ ID NO: 734719 - DNA, 59 bp, Homo sapiens
ccgttcctgagcatgctgcccgcctgcagcgcttggcccagatccacattcagcagcag

SEQ ID NO: 734720 - DNA, 90 bp, Homo sapiens
gaggaccgcgtggtcgtcatccgcttcggccacgactgggatcctacgtgcatgaagatggacgaggtcctgtacagcatcgccgagaag

SEQ ID NO: 734721 - DNA, 2265 bp, Homo sapiens
tgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggatcagtgaaaaacattagtatacgtttttaaataggctaatttttcaacttggatcattaggcttacgtactacttgtttcaaatgtgtcaaatacaaaaatggtaactaggttgacagatactttgtatttttcttttgaattcagacctggaatgtaagtaagtgacaatgcttatggaaagccagttagttagaattggaaatctgtcttgtcattttacaagcattagattcctttcctgtgtgaagaaagcctcagtgaaacaggtctttgccataactttatgaagtgctacagaaagcacaaagaattgattcatgttcatcaatacctgctgagagtactgtcccaggaatatccagtggatggattcatcatccaggaggttcaaaagtaagatggttttcaaatcatttttgagactggttgcataacagcagggtacctgaaagagccttctgggagttagtgaactaggtagattgttttgttcacataacgccaccatcaacttaaagtgaattgtctttgttataaatgaggtcactatggacttaccctaaagatcttctgtacttctgtcttccataggacaaatgataagtactacatacctcatctcttgggttattattgtagtcttgcattcatgattatgaatttaaaaataaataccaattatggaaatagtactaaaggcttgccgcgcatgaaacattattttaattggtttaaagtccctttataaagagtgctacatggtttagataaaggaaacatataactattgagttacaggggattttattaattataaaatgcaatcaatttaaattacgtaggtttaagactagtcccttggataagccccaagcgaatttgtcttcagattattaaaattagtgctgtaaatcagggtgggcaattcacagcctttctgaactgactgaactagagcttgcagtgaagtgttctgctgagactgagcaccttacagatatttttctccagaagatggtgctgggtaataaaatcatcacaattagggaatggttagtggtctctactgtggcaaatgccaactgttggaattcactttattgtagaaaaacccaaactgagactcttaagttttgtttagcaatgtgtttctggtatgaaacaaactactgtgtcactgtccaggtaggaaacaattctttcaactgggttttcagcataaatgggaactgatgtagaaggcaggatttagcccttctaggcaaaagaaaagctcagttgggtttcacgagtgttcctgtgcttatattcagtctgtgcctacatgttctcatgcatgtctaacctgatttacctcttacctgtaacctaccttatcatgtggcttttaattggcagtcactcagccatttctaagcagatatagtactacctttcagaactcacattggcaagtgtaaaaagatgacttaaggtgaagtgaggacaaaatcacattctgcatactaacctatttttttctccctttaaggtgctaaacttgcacctcatgtccactcagtaacaagtattgggacgtagagcacagcctcactcagctctgaaaggtaatacagcctgtgaggaagtgagccagcagtggcctttgcaattgtggatcttaagctctgctctcagcagatttcaggtgtaaccatttgttaactgtactgaaggtgtgtcctcaagaagaaagtgttcaaattaaaaaagctgctgccaagtacactgtgtggtcttctcctttgaatcctagggttctatccctcttcagagtcatgtttctggtgctgctactttaaaacacagctcacaagaataactaacttgctcaaatatggagaaaactcaatagggttcagggaggttctggcagtgtgcagtgtgaaataatcctgagtccttgctgaacacaactgtag

SEQ ID NO: 734722 - DNA, 119 bp, Homo sapiens
tccaggtgacatacctcccctccagtcagaagagtaaacgtgccaagcacttccttgaattgaagagctttaaggataactataacacattggagagtactctgtgacggagctgaagg

SEQ ID NO: 734723 - DNA, 107 bp, Homo sapiens
gcaaacatatctacctctccacccgaattgatggcagcctggtcatcaggccatacactcctgtcaccagtgatgaggatcaaggctatgtggatcttgtcatcaag

SEQ ID NO: 734724 - DNA, 247 bp, Homo sapiens
cctctacatgctaggatcacaggaagactttgtaaggacagtttaagttctcctgcaaggtttaatttgttatcatgtaaatattccaaagcaggctgccttgtggttttggccagccttgtgctatgttgataagattgatttactgcttaaaatcactttactttatccaatttttactgaactttttatgtaaaaaaataaaatcaattaaagaacttggcatgtgtgttccctaaaagttaat

SEQ ID NO: 734725 - DNA, 49 bp, Homo sapiens
ggttgatgatgtcgtgaaaagactcttgtctttggaaatggccaacaag

SEQ ID NO: 734726 - DNA, 1625 bp, Homo sapiens
tcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgcgggtaagttgaggttatcttgggataaagggtcttctagggcacaaaactcactctaggtttatattgtatgtagcttatattttttactaaggtgtcaccttataagcatctataaattgagttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagagacccaacaacagcttttaaagtgtcttctatttcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccgggac

SEQ ID NO: 734727 - DNA, 194 bp, Homo sapiens
aaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttag

SEQ ID NO: 734728 - DNA, 32 bp, Homo sapiens
ctttgacaattattctgccaatgttatggtag

SEQ ID NO: 734729 - DNA, 976 bp, Homo sapiens
tcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattc

SEQ ID NO: 734730 - DNA, 121 bp, Homo sapiens
catccctgcctcttgtcacaaactgccccagcaagaatttgaggttctgacaacagtacccatcccccacagtaccccttcagctcagtttctagaaagctcccttttctttgaaatctgc

SEQ ID NO: 734731 - DNA, 117 bp, Homo sapiens
ctcctttagcggcagagttttccgagtgaccttcttgatgctggctgtttctctcaccgttcccctgcttggagccatgatgctgctggaatctcctatagatccacagcctctcag

SEQ ID NO: 734732 - DNA, 126 bp, Homo sapiens
atcagccggcagtccattgatgcactcaaagactggttcagagatgaaatgcagaagagtgactggcagcttattgtggagctgaagaaagtatttgaaatcatctaattttttcacatggagcag

SEQ ID NO: 734733 - DNA, 602 bp, Homo sapiens
tttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtaca

SEQ ID NO: 734734 - DNA, 58 bp, Homo sapiens
gttccagggggctgttttgtaatgagatgctgctggcaggccactcagaggctcccag

SEQ ID NO: 734735 - DNA, 190 bp, Homo sapiens
gttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccag

SEQ ID NO: 734736 - DNA, 290 bp, Homo sapiens
ccgctggaaagctgaagactgtcgcctgctccgaatttccgtcatcaactttcttgaccagctttccctggtggtgcggaccatgcagcgctttgggccccccgtttcccgctaagcctggcctgggcaaatggagcgaggtcccactttgcgtctccttgtaggcagtgcgtccatccttccctagggcaggaattcccacagttgctactttcctgggagggcctcatgttttatctggttcttaaatgtttgttactacagaaaataaaactgcgctactattccaa

SEQ ID NO: 734737 - DNA, 79 bp, Homo sapiens
cccattttaattttattcattttttcctttgccattgatttttgagactcatgcattaaattcactagaaacccaaaaa

SEQ ID NO: 734738 - DNA, 80 bp, Homo sapiens
ggaggaggaggatggaggcggtggtgttcgtcttctctctcctcgattgttgcgcgctcatcttcctctcggtctacttc

SEQ ID NO: 734739 - DNA, 75 bp, Homo sapiens
agatgggtgggcgttgtgaatttgaagaagtgcaaggtttccttgaccaggttgcccacaagttgcccttcgcag

SEQ ID NO: 734740 - DNA, 112 bp, Homo sapiens
gttagtgtttctagcattatcccatccctttgagccattcaggggtacttgtgcatttaaaaaccaacacaaaaagatgtaaatacttaacactcaaatattaacattttag

SEQ ID NO: 734741 - DNA, 2707 bp, Homo sapiens
gtggggtccctggccatcttcccactggtctatgccatccccctcgccctcagcaccgaggccattctccattccaacaacaccagggacatggagtccgaccgggaggctggtatcgtcacgctggccatcctcatcggccccacgttctcctacattctctacaacacactgctcttcctgccctacctggtcttcagcatcctggccacacactgcaccatcagcctggcactccccctgcttaccattcccatggccttctcccttgagagacagtttcgaagccaggccttcaacaaactgccccagaggactgccaagctcaacctcctgctgggacttttctatgtctttggcatcattctggcaccagcaggcagtctgcccaaaatttaaggggacaagtagctccccccacgacatgtctccctttcttagaatatattaaagtcagagtctctgaggaaggaatgtgatttggcagtcagggtactaagcatgggtgggaactcctgccttataaaaattgtttttgtgttcttaaagataatatgttgtttttctgtttttgttttttccattttatggggaatttaaaaaccattcttgtatcagaaggtgaattaggcgcatggtctttgttttattaataatttccactagagggtgttctcaggtcactttgcagtgaagtggacttagttcctccttgttctgtacaaaatgtctccagactttgtaaaggagctgcccagtttggcctcctgtcccgaaaagaccctaataactaggcagagtgttgtcctgctttcttcgtctcgtaggatgtgctatgattggtgccaggcctcactaacacaggggctacctgtctcttattctcagcacctgtgtcctgagatacgctgcctgagacagagagagtccctcattaacagcctgtgtggctgtcagctttttgcctaaattgtgattcagatgcttttgttctctctcctttcacttattgccacagttgaggaaaagtgtcagattaccctgcagcaagacaagccaaggactgggagggaaaaaaaaaccactctggaggcaactgagaaaatcactgctttggataggaatcagtagggtggctgttttccctttgttgaatctactagagtgacaggaaggactcccagccctttcagtaactatcaggagccctgaaacggtagaggcactgccatccttgtgggatactcaaagcccacagggcttttccctccctattgcatcttctgatgctccccacacctaccctccacctctccacctctgtggtgttcccatttgtgtgtttcccatctgtggagccagactgagcaatagcttagcagcgagtcagggacagctgccactttccacagagccacaggatgggcagagcagggacccagggaatgaatagccagtggacaaacagtcttgagctctgttcagccagagtgatgggccctgccagttaaggggctgtgtcttcatccttgaagacagatgtgcaatattgaccctgcctctccccagggctttgtggaaagatagttgagggctttagtgagatcacactcagagtggggcaattccagcatttatcctggctgcgtttcattgcattgtctgtgaagtataatttctgggccagaattgctcagttgcatttgatccaggactatagattggaaatgggtcatcattgttttctgttgtgattatagccattctagtaggcgtttaaggtcatggcctgcagaaaatgatgtaagaactagttcttaatctttcagatcaagctaatgatgatatggaaccttgagttcgaattgattggtttacttggaaaaaaacatgtttgaaaattgcaaaagttccgccgggcgcggtggctcatgcctgtaatcccagcactttgggaggccgagacgggcggatcacgaggtcaggagatcgagaccatcttggctaacacggtgaaaccccgtttctactaaaaatacaaaaaattagccaggcgtgttggcgggcgcctgtagtcccagctacctgggcggctgaggcaggagcatggcgtgaacccaggaggcggagcttgcagtgagctgagatcatgccactgcactccaacctgggggacacagcaagactccgtctcaaaaaaaaaaaaagaaaaagaaaattgcaaaagttcctctaaagttaaatcaaaggtggtttgtctagcagagagccagaatcttctaatagtgggcagagcccagagacaaggggaagaaagatgaccttctccccagtccttcccagcaccatttttgtttcacaccaggcttgtggcattttggtgctcacaggggttttgccttctgacctctccttggagtaggccattctcatgcagggctcaccctgaggcaggaggaccaagggctccctgcgtccacggaccacgtatgccttggtggtcactcccatcggggctatcagttctgcactgtgccctggtgcggattttaatgcatatttttatatataaatgttcccaaaggccaaatttgttgccaggttttatacgcaggtcaccataatttgtattatgttccctgagtcaatgaaggttttctttagacttcttaattaaaaagagaagaaagaaaatgttccaaaaaag

SEQ ID NO: 734742 - DNA, 317 bp, Homo sapiens
gtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattgggg

SEQ ID NO: 734743 - DNA, 127 bp, Homo sapiens
ggagtgctgctgtatggacctccaggcactgggaagacactgttggcccgggctgtggctcatcatacggactgtacctttattcgtgtctctggctctgaattggtacagaaattcataggggaag

SEQ ID NO: 734744 - DNA, 123 bp, Homo sapiens
caaggaggaggagctgcagtgctaagtccagccagcgtgcagctgcatccagaaaccggccactacccagcccatctctgcctgtgcttatccagataagaagaccaaaatcccgctgggaaa

SEQ ID NO: 734745 - DNA, 152 bp, Homo sapiens
acattccatacaccaagcttgggtgatgaggaatttgaaatcccacctatctccttggattctgatccctcattggctgtctcagatgtggttggccactttgatgacctggcagacccttcctcttcacaggatggcagtttttcagccca

SEQ ID NO: 734746 - DNA, 70 bp, Homo sapiens
ctggctggatggcaagcatgtggtgtttggagaggtcaccgaaggcctagatgtcttgcggcaaattgag

SEQ ID NO: 734747 - DNA, 74 bp, Homo sapiens
accataacttttttttaaggacaaaagttgttgccttcctaagaaccttctttaataaactcattttaaaactc

SEQ ID NO: 734748 - DNA, 64 bp, Homo sapiens
tgtttgtttcaattggccatttaagtttagtagtaaaagactggttaatgataacaatgcatcg

SEQ ID NO: 734749 - DNA, 46 bp, Homo sapiens
caagctcctgccccagcttacctacttggatggctatgaccgagag

SEQ ID NO: 734750 - DNA, 127 bp, Homo sapiens
caagccctgcgtccagcgagcgtcacagcacaacctgcaaaaacggagctgggctgcagctggggctggcatggactttcatttcagagattcggtttttaagaagatgcatgcctaatgtgttctt

SEQ ID NO: 734751 - DNA, 32 bp, Homo sapiens
tccatgattgtgaacaatctcttgaaacccat

SEQ ID NO: 734752 - DNA, 60 bp, Homo sapiens
aacccaacattgatagtcccttgaacacacatgctgccgagctctggaaaaaccccacag

SEQ ID NO: 734753 - DNA, 154 bp, Homo sapiens
ggcatgggaaggatttaacaccgatatattgttaccgctgaaaatgaactttatgaaccttttccaagttgatctatccagtgacgtggcctggtgggcgtttcttcttgtacttatgtggttttttggcttttaatacagacattttcctcca

SEQ ID NO: 734754 - DNA, 181 bp, Homo sapiens
atctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccg

SEQ ID NO: 734755 - DNA, 43 bp, Homo sapiens
acatgtatcctttcacacatttgccttgacaaacttctttcac

SEQ ID NO: 734756 - DNA, 166 bp, Homo sapiens
aattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttgg

SEQ ID NO: 734757 - DNA, 127 bp, Homo sapiens
tgcgcgacatggaaggtgatctgcaagagctgcatcagtcaaacaccggggataaatctggatttgggttccggcgtcaaggtgaagataatacctaaagaggaacactgtaaaatgccagaagcag

SEQ ID NO: 734758 - DNA, 243 bp, Homo sapiens
gagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaaaa

SEQ ID NO: 734759 - DNA, 95 bp, Homo sapiens
ggcaacgcaatctataatctccttccagatatcatcagccgcctgtcagaccccgagctgggggtggaggaagagcctttccacaccatcatgaa

SEQ ID NO: 734760 - DNA, 120 bp, Homo sapiens
cacatggatagcacagttgtcagacaagattccttcagattccgagttgcctaccggttgttttcgttgttgttgttgttgtttttctttttctttttttttttgaagacagcaataacc

SEQ ID NO: 734761 - DNA, 2416 bp, Homo sapiens
acctcggaaggtttctaatctctcttaaggttgggtttcttgagtgtgtaatggggatatgtgtcctatgctgctcacaaggattttgttggcatcttatttgatgacttcactgaaaacccgttattgtaacacactctgttgatgtaagctattttgacatgatcatccatgttctgcgggagaagctcaaatagtagatctctgaggaaactcacgcatgttgaaggagtggagtcggtgctttaggaaggaaaatctgtgtgtgggtctcaagtctcaccgcatgggtcataacctattcctgaccctgacagaaaatccttctagaaataaaagagaaataaaggaaatccaccataccaaggcataaaaagacagccatgaaaaagtaacataaggggagaggaagatgggcttataacagattacaggatgttgtcagttttaataacgtgatgtgaagaaaagattctgtttgcacacagggagaggttcttttcctggctagtcaaagcacaccttacgtacattctgaagccgtctcttatatgattcatttttttcactgtagataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagaggcagcagtggcagtggattgatggggccatgtatctgtacagatcctggtctggcaagtccatgggtgggaacaagcactgtgctgagatgagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctacacccttctgccctctctccattgcctgcaccccaccccagccactcaactcctgcttgtttttcctttggccataggaaggtttaccagtagaatccttgctaggttgatgtgggccatacattcctttaataaaccattgtgtacataagaggttgctgtgttccagttcagtaatggtgaatgtggaaaagtgaaataagaccaagaaatacacccaagtgcttcttcgtctccttcatctgagtctctgcctcctccaccccagcaacagcactggttcaaggagaggagagatgcaggtgacatgcctgccaacttctgagcaaggttgggcgagtgggtgctatttagttgtaagtgcttctcagcttatgagggggatgacagtcacagcaggtatggtggagctgacctggaccctggacactcttctcccccactgccactgacaacatgtgtggccttgtgtgactctctttgccctgtgaggtttgcaatggcttatgaggtggttacttcaataataaggatgtgattttgcctgcaaacagatatatgactccccaggtcacgaatctgagtggtcatgtaaacagaagcaaatatggactcaatgattatagcatatggctgtggtatgatcacattcgcattccttagagggaaatgccaccatacaagagaggccatgtgggttggccatgcagttcaggctg

SEQ ID NO: 734762 - DNA, 3861 bp, Homo sapiens
gacatgaccatcagagaggcccggaatggtagtccccagcatacagtgacaaaagttaagcaactaatatttttgggaaacatgtaaagtctcttcagggattctcagaactacagctggaggaaagtggtttcctgcactcatatgtgggtgagtagagcacagtttgttattgaatgtttaatggaatggtgacctcctaaaagatggcggcttggagacatttgagatatcaagagattaaccaaactcatgtgccaccattctcacaaggatatttggaatgtcctgacttattttgggctttgagtcagaaaaatgattcgtaaggccagctccacctcttctatctcaaaagctcggaagagatctatggtatttggccaaatgctagctataattgcctttctgtggtttgacgtcaattaatgactggactttgtacccgaaagacagttaaaacgaaaggtagccaggaagggaaatcatttcctccacgcgtccgagcaagaacagctaaaatgaaagccatcattcatcttactcttcttgctctcctttctgtaaacacagccaccaaccaaggcaactcagctgatgctgtaacaaccacagaaactgcgactagtggtcctacagtagctgcagctgataccactgaaactaatttccctgaaactgctagcaccacagcaaatacaccttctttcccaacagctacttcacctgctccccccataattagtacacatagttcctccacaattcctacacctgctccccccataattagtacacatagttcctccacaattcctatacctactgctgcagacagtgagtcaaccacaaatgtaaattcattagctacctctgacataatcaccgcttcatctccaaatgatggattaatcacaatggttccttctgaaacacaaagtaacaatgaaatgtcccccaccacagaagacaatcaatcatcagggcctcccactggcaccgctttattggagaccagcaccctaaacagcacaggtcccagcaatccttgccaagatgatccctgtgcagataattcgttatgtgttaagctgcataatacaagtttttgcctgtgtttagaagggtattactacaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcttccagtctcaagtgtcctgatgcctgcaacgcacagcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgaacttgtgtctggggcttttttttcatttctttttctttctttcttttttttttttttttttttgagacactgtcttgctctgtcacccaggctggagtgcagtagtgtgaacatgactcactgtagcctcaaactcctgggttcaaacaatcctcccatataagcctcctgagtaggtggggctacagaagtgtgctgtcatgcccagctaatttttttttgttgttgttagagacagggtctcactatgttgcccaggctgagtttgggggttttgatgatgcacacagcagttagtctcattttaaatagcaaacgtgacacatggtaaatgggagtgactgatatctgctatccttattaggggttattggattacccaagataacgttctactgtttagtagacatttgcttcctccacgcacatcccactcctaccccatgatgatgagcattttgggtggggctgatcctgctcccagctacagaggttggct

SEQ ID NO: 734763 - DNA, 3823 bp, Homo sapiens
gacatgaccatcagagaggcccggaatggtagtccccagcatacagtgacaaaagttaagcaactaatatttttgggaaacatgtaaagtctcttcagggattctcagaactacagctggaggaaagtggtttcctgcactcatatgtgggtgagtagagcacagtttgttattgaatgtttaatggaatggtgacctcctaaaagatggcggcttggagacatttgagatatcaagagattaaccaaactcatgtgccaccattctcacaaggatatttggaatgtcctgacttattttgggctttgagtcagaaaaatgattcgtaaggccagctccacctcttctatctcaaaagctcggaagagatctatggtatttggccaaatgctagctataattgcctttctgtggtttgacgtcaattaatgactggactttgtacccgaaagacagttaaaacgaaaggtagccaggaagggaaatcatttcctccacgcgtccgagcaagaacagctaaaatgaaagccatcattcatcttactcttcttgctctcctttctgtaaacacagccaccaaccaaggcaactcagctgatgctgtaacaaccacagaaactgcgactagtggtcctacagtagctgcagctgataccactgaaactaatttccctgaaactgctagcaccacagcaaatacaccttctttcccaacagctacttcacctgctccccccataattagtacacatagttcctccacaattcctacacctgctccccccataattagtacacatagttcctccacaattcctatacctactgctgcagacagtgagtcaaccacaaatgtaaattcattagctacctctgacataatcaccgcttcatctccaaatgatggattaatcacaatggttccttctgaaacacaaagtaacaatgaaatgtcccccaccacagaagacaatcaatcatcagggcctcccactggcaccgctttattggagaccagcaccctaaacagcacaggtcccagcaatccttgccaagatgatccctgtgcagataattcgttatgtgttaagctgcataatacaagtttttgcctgtgtttagaagggtattactacaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgaacttgtgtctggggcttttttttcatttctttttctttctttcttttttttttttttttttttgagacactgtcttgctctgtcacccaggctggagtgcagtagtgtgaacatgactcactgtagcctcaaactcctgggttcaaacaatcctcccatataagcctcctgagtaggtggggctacagaagtgtgctgtcatgcccagctaatttttttttgttgttgttagagacagggtctcactatgttgcccaggctgagtttgggggttttgatgatgcacacagcagttagtctcattttaaatagcaaacgtgacacatggtaaatgggagtgactgatatctgctatccttattaggggttattggattacccaagataacgttctactgtttagtagacatttgcttcctccacgcacatcccactcctaccccatgatgatgagcattttgggtggggctgatcctgctcccagctacagaggttggct

SEQ ID NO: 734764 - DNA, 2747 bp, Homo sapiens
gcggccgctcgcgattggaaccaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcttccagtctcaagtgtcctgatgcctgcaacgcacagcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgaacttgtgtctggggcttttttttcatttctttttctttctttcttttttttttttttttttttgagacactgtcttgctctgtcacccaggctggagtgcagtagtgtgaacatgactcactgtagcctcaaactcctgggttcaaacaatcctcccatataagcctcctgagtaggtggggctacagaagtgtgctgtcatgcccagctaatttttttttgttgttgttagagacagggtctcactatgttgcccaggctgagtttgggggttttgatgatgcacacagcagttagtctcattttaaatagcaaacgtgacacatggtaaatgggagtgactgatatctgctatccttattaggggttattggattacccaagataacgttctactgtttagtagacatttgcttcctccacgcacatcccactcctaccccatgatgatgagcattttgggtggggctgatcctgctcccagctacagaggttggct

SEQ ID NO: 734765 - DNA, 2709 bp, Homo sapiens
gcggccgctcgcgattggaaccaactcttctacatgtaagaaaggaaaggtattccctgggaagatttcagtgacagtatcagaaacatttgacccagaagagaaacattccatggcctatcaagacttgcatagtgaaattactagcttgtttaaagatgtatttggcacatctgtttatggacagactgtaattcttactgtaagcacatctctgtcaccaagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcacaagcaatgcttaataaagaagagtggtggggcccctgagtgtgcgtgcgtgcccggctaccaggaagatgctaatgggaactgccaaaagtgtgcatttggctacagtggactcgactgtaaggacaaatttcagctgatcctcactattgtgggcaccatcgctggcattgtcattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggaacccgccatggcccccaaccaatgtacaagctattatttagagtgtttagaaagactgatggagaagtgagcaccagtaaagatctggcctccggggtttttcttccatctgacatctgccagcctctctgaatggaagttgtgaatgtttgcaacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggagacatacgcatcaactgtggaggtccgaggggatgagaagggatacccaccatctttcaagggtcacaagctcactctctgacaagtcagaatagggacactgcttctatccctccaatggagagattctggcaacctttgaacagcccagagcttgcaacctagcctcacccaagaagactggaaagagacatatctctcagctttttcaggaggcgtgcctgggaatccaggaactttttgatgctaattagaaggcctggactaaaaatgtccactatggggtgcactctacagtttttgaaatgctaggaggcagaaggggcagagagtaaaaaacatgacctggtagaaggaagagaggcaaaggaaactgggtggggaggatcaattagagaggaggcacctgggatccaccttcttccttaggtcccctcctccatcagcaaaggagcacttctctaatcatgccctcccgaagactggctgggagaaggtttaaaaacaaaaaatccaggagtaagagccttaggtcagtttgaaattggagacaaactgtctggcaaagggtgcgagagggagcttgtgctcaggagtccagccgtccagcctcggggtgtaggtttctgaggtgtgccattggggcctcagccttctctggtgacagaggctcagctgtggccaccaacacacaaccacacacacacaaccacacacacaaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcctttgttagatggtgaacttgtgtctggggcttttttttcatttctttttctttctttcttttttttttttttttttttgagacactgtcttgctctgtcacccaggctggagtgcagtagtgtgaacatgactcactgtagcctcaaactcctgggttcaaacaatcctcccatataagcctcctgagtaggtggggctacagaagtgtgctgtcatgcccagctaatttttttttgttgttgttagagacagggtctcactatgttgcccaggctgagtttgggggttttgatgatgcacacagcagttagtctcattttaaatagcaaacgtgacacatggtaaatgggagtgactgatatctgctatccttattaggggttattggattacccaagataacgttctactgtttagtagacatttgcttcctccacgcacatcccactcctaccccatgatgatgagcattttgggtggggctgatcctgctcccagctacagaggttggct

SEQ ID NO: 734766 - DNA, 1633 bp, Homo sapiens
aacacaactttgtctcttcagcctggcaagagctgaggcactgaaaacttcttttttcccctagaaaatgacacactctcctcctaagggtccctttgattttgtcctggtggaaagcaacaaagagaagaacgtgaacaggaatatgtatatttcagttgtcatctgagtcccatggataggaggctcaattctcttcttcatctttcagatctccgcagaccctgccctctcactgtacaattcagagattgacactcagcaggcattcaataaacgtctgtgtcaaatgagaacaacttgatggggcaagtaggagtcaatcctgcatccctccctccctttttttcctctccattcgacctttagggctctggtttcctgtaagcagtgaattatttacctctgctcatagatatcaaattggcccttcccaggttgcagcagggtggggcggggaggcggccttgttcagtctgttaataggaggagcaacctccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggcaccacacacaccaccaccaacacaacccgcgcctttttccggggcacaacgcta

SEQ ID NO: 734767 - DNA, 849 bp, Homo sapiens
  misc_feature (52)..(52): n is a, c, g, or t
  misc_feature (60)..(60): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (75)..(76): n is a, c, g, or t
aaggagagtttgtatcataagtaggtgttggattatgtcatatgcgtatgtnctgcatcnggtgantgntcnccnntccgcggattggcgaccatttcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggcaccacacacaccaccaccaacacaacccgcgcctttttccggggcacaacgcta

SEQ ID NO: 734768 - DNA, 1337 bp, Homo sapiens
aacacaactttgtctcttcagcctggcaagagctgaggcactgaaaacttcttttttcccctagaaaatgacacactctcctcctaagggtccctttgattttgtcctggtggaaagcaacaaagagaagaacgtgaacaggaatatgtatatttcagttgtcatctgagtcccatggataggaggctcaattctcttcttcatctttcagatctccgcagaccctgccctctcactgtacaattcagagattgacactcagcaggcattcaataaacgtctgtgtcaaatgagaacaacttgatggggcaagtaggagtcaatcctgcatccctccctccctttttttcctctccattcgacctttagggctctggtttcctgtaagcagtgaattatttacctctgctcatagatatcaaattggcccttcccaggttgcagcagggtggggcggggaggcggccttgttcagtctgttaataggaggagcaacctccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccgaagcagttgccgcatccgaagcagttgccgcatccgaagcagttgccgtatccgaagcagttgccgcatccgaagcagttgccgcatccgaagcagttgccg

SEQ ID NO: 734769 - DNA, 1392 bp, Homo sapiens
aacacaactttgtctcttcagcctggcaagagctgaggcactgaaaacttcttttttcccctagaaaatgacacactctcctcctaagggtccctttgattttgtcctggtggaaagcaacaaagagaagaacgtgaacaggaatatgtatatttcagttgtcatctgagtcccatggataggaggctcaattctcttcttcatctttcagatctccgcagaccctgccctctcactgtacaattcagagattgacactcagcaggcattcaataaacgtctgtgtcaaatgagaacaacttgatggggcaagtaggagtcaatcctgcatccctccctccctttttttcctctccattcgacctttagggctctggtttcctgtaagcagtgaattatttacctctgctcatagatatcaaattggcccttcccaggttgcagcagggtggggcggggaggcggccttgttcagtctgttaataggaggagcaacctccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgagtccctcaagcgccaagtattaactgcacattttag

SEQ ID NO: 734770 - DNA, 1843 bp, Homo sapiens
aacacaactttgtctcttcagcctggcaagagctgaggcactgaaaacttcttttttcccctagaaaatgacacactctcctcctaagggtccctttgattttgtcctggtggaaagcaacaaagagaagaacgtgaacaggaatatgtatatttcagttgtcatctgagtcccatggataggaggctcaattctcttcttcatctttcagatctccgcagaccctgccctctcactgtacaattcagagattgacactcagcaggcattcaataaacgtctgtgtcaaatgagaacaacttgatggggcaagtaggagtcaatcctgcatccctccctccctttttttcctctccattcgacctttagggctctggtttcctgtaagcagtgaattatttacctctgctcatagatatcaaattggcccttcccaggttgcagcagggtggggcggggaggcggccttgttcagtctgttaataggaggagcaacctccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcagagcaggagagacagaagtagcaaaccctctttcgagatgtccctccagccccagaagtacctccagcctcacaccatctcttcagcctagcaagttgctggagggagtctataacctaccaggagccagccagccatttgtatcaagaaatagaaatctgccagggtacagtggctcacacctataatcccagcgctttgggaggctaaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggcaccacacacaccaccaccaacacaacccgcgcctttttccggggcacaacgcta

SEQ ID NO: 734771 - DNA, 1602 bp, Homo sapiens
aacacaactttgtctcttcagcctggcaagagctgaggcactgaaaacttcttttttcccctagaaaatgacacactctcctcctaagggtccctttgattttgtcctggtggaaagcaacaaagagaagaacgtgaacaggaatatgtatatttcagttgtcatctgagtcccatggataggaggctcaattctcttcttcatctttcagatctccgcagaccctgccctctcactgtacaattcagagattgacactcagcaggcattcaataaacgtctgtgtcaaatgagaacaacttgatggggcaagtaggagtcaatcctgcatccctccctccctttttttcctctccattcgacctttagggctctggtttcctgtaagcagtgaattatttacctctgctcatagatatcaaattggcccttcccaggttgcagcagggtggggcggggaggcggccttgttcagtctgttaataggaggagcaacctccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcagagcaggagagacagaagtagcaaaccctctttcgagatgtccctccagccccagaagtacctccagcctcacaccatctcttcagcctagcaagttgctggagggagtctataacctaccaggagccagccagccatttgtatcaagaaatagaaatctgccagggtacagtggctcacacctataatcccagcgctttgggaggctaaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgagtccctcaagcgccaagtattaactgcacattttag

SEQ ID NO: 734772 - DNA, 1547 bp, Homo sapiens
aacacaactttgtctcttcagcctggcaagagctgaggcactgaaaacttcttttttcccctagaaaatgacacactctcctcctaagggtccctttgattttgtcctggtggaaagcaacaaagagaagaacgtgaacaggaatatgtatatttcagttgtcatctgagtcccatggataggaggctcaattctcttcttcatctttcagatctccgcagaccctgccctctcactgtacaattcagagattgacactcagcaggcattcaataaacgtctgtgtcaaatgagaacaacttgatggggcaagtaggagtcaatcctgcatccctccctccctttttttcctctccattcgacctttagggctctggtttcctgtaagcagtgaattatttacctctgctcatagatatcaaattggcccttcccaggttgcagcagggtggggcggggaggcggccttgttcagtctgttaataggaggagcaacctccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcagagcaggagagacagaagtagcaaaccctctttcgagatgtccctccagccccagaagtacctccagcctcacaccatctcttcagcctagcaagttgctggagggagtctataacctaccaggagccagccagccatttgtatcaagaaatagaaatctgccagggtacagtggctcacacctataatcccagcgctttgggaggctaaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccgaagcagttgccgcatccgaagcagttgccgcatccgaagcagttgccgtatccgaagcagttgccgcatccgaagcagttgccgcatccgaagcagttgccg

SEQ ID NO: 734773 - DNA, 1471 bp, Homo sapiens
aacacaactttgtctcttcagcctggcaagagctgaggcactgaaaacttcttttttcccctagaaaatgacacactctcctcctaagggtccctttgattttgtcctggtggaaagcaacaaagagaagaacgtgaacaggaatatgtatatttcagttgtcatctgagtcccatggataggaggctcaattctcttcttcatctttcagatctccgcagaccctgccctctcactgtacaattcagagattgacactcagcaggcattcaataaacgtctgtgtcaaatgagaacaacttgatggggcaagtaggagtcaatcctgcatccctccctccctttttttcctctccattcgacctttagggctctggtttcctgtaagcagtgaattatttacctctgctcatagatatcaaattggcccttcccaggttgcagcagggtggggcggggaggcggccttgttcagtctgttaataggaggagcaacctccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggcaccacacacaccaccaccaacacaacccgcgcctttttccggggcacaacgcta

SEQ ID NO: 734774 - DNA, 1230 bp, Homo sapiens
aacacaactttgtctcttcagcctggcaagagctgaggcactgaaaacttcttttttcccctagaaaatgacacactctcctcctaagggtccctttgattttgtcctggtggaaagcaacaaagagaagaacgtgaacaggaatatgtatatttcagttgtcatctgagtcccatggataggaggctcaattctcttcttcatctttcagatctccgcagaccctgccctctcactgtacaattcagagattgacactcagcaggcattcaataaacgtctgtgtcaaatgagaacaacttgatggggcaagtaggagtcaatcctgcatccctccctccctttttttcctctccattcgacctttagggctctggtttcctgtaagcagtgaattatttacctctgctcatagatatcaaattggcccttcccaggttgcagcagggtggggcggggaggcggccttgttcagtctgttaataggaggagcaacctccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgagtccctcaagcgccaagtattaactgcacattttag

SEQ ID NO: 734775 - DNA, 1175 bp, Homo sapiens
aacacaactttgtctcttcagcctggcaagagctgaggcactgaaaacttcttttttcccctagaaaatgacacactctcctcctaagggtccctttgattttgtcctggtggaaagcaacaaagagaagaacgtgaacaggaatatgtatatttcagttgtcatctgagtcccatggataggaggctcaattctcttcttcatctttcagatctccgcagaccctgccctctcactgtacaattcagagattgacactcagcaggcattcaataaacgtctgtgtcaaatgagaacaacttgatggggcaagtaggagtcaatcctgcatccctccctccctttttttcctctccattcgacctttagggctctggtttcctgtaagcagtgaattatttacctctgctcatagatatcaaattggcccttcccaggttgcagcagggtggggcggggaggcggccttgttcagtctgttaataggaggagcaacctccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccgaagcagttgccgcatccgaagcagttgccgcatccgaagcagttgccgtatccgaagcagttgccgcatccgaagcagttgccgcatccgaagcagttgccg

SEQ ID NO: 734776 - DNA, 1093 bp, Homo sapiens
aactgctcagggtagactggagacaaaagcaacagctcagaagtgctaaatcttgaagagcagccaaagcatgggcaacaaagtgagaccccatctctacaaaaaaaaaaaaaaattagccgggcatggtggcctgtgtctgtagtctcagctactaaagaggctgaagcaggaggaatgcttgagcccagaagttcaaggctgcagtgagcaacacctcgtctgtcttgtctctctctctttcacagtgaaaaagaatgaccctggggagggagtgtaggagggtgaaagagtttcatgttgtggatctttctcttcccccacccactgtccacgcactttgtctttttcctcccctaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggcaccacacacaccaccaccaacacaacccgcgcctttttccggggcacaacgcta

SEQ ID NO: 734777 - DNA, 852 bp, Homo sapiens
aactgctcagggtagactggagacaaaagcaacagctcagaagtgctaaatcttgaagagcagccaaagcatgggcaacaaagtgagaccccatctctacaaaaaaaaaaaaaaattagccgggcatggtggcctgtgtctgtagtctcagctactaaagaggctgaagcaggaggaatgcttgagcccagaagttcaaggctgcagtgagcaacacctcgtctgtcttgtctctctctctttcacagtgaaaaagaatgaccctggggagggagtgtaggagggtgaaagagtttcatgttgtggatctttctcttcccccacccactgtccacgcactttgtctttttcctcccctaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgagtccctcaagcgccaagtattaactgcacattttag

SEQ ID NO: 734778 - DNA, 797 bp, Homo sapiens
aactgctcagggtagactggagacaaaagcaacagctcagaagtgctaaatcttgaagagcagccaaagcatgggcaacaaagtgagaccccatctctacaaaaaaaaaaaaaaattagccgggcatggtggcctgtgtctgtagtctcagctactaaagaggctgaagcaggaggaatgcttgagcccagaagttcaaggctgcagtgagcaacacctcgtctgtcttgtctctctctctttcacagtgaaaaagaatgaccctggggagggagtgtaggagggtgaaagagtttcatgttgtggatctttctcttcccccacccactgtccacgcactttgtctttttcctcccctaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccgaagcagttgccgcatccgaagcagttgccgcatccgaagcagttgccgtatccgaagcagttgccgcatccgaagcagttgccgcatccgaagcagttgccg

SEQ ID NO: 734779 - DNA, 608 bp, Homo sapiens
  misc_feature (52)..(52): n is a, c, g, or t
  misc_feature (60)..(60): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (75)..(76): n is a, c, g, or t
aaggagagtttgtatcataagtaggtgttggattatgtcatatgcgtatgtnctgcatcnggtgantgntcnccnntccgcggattggcgaccatttcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgagtccctcaagcgccaagtattaactgcacattttag

SEQ ID NO: 734780 - DNA, 553 bp, Homo sapiens
  misc_feature (52)..(52): n is a, c, g, or t
  misc_feature (60)..(60): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (75)..(76): n is a, c, g, or t
aaggagagtttgtatcataagtaggtgttggattatgtcatatgcgtatgtnctgcatcnggtgantgntcnccnntccgcggattggcgaccatttcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccgaagcagttgccgcatccgaagcagttgccgcatccgaagcagttgccgtatccgaagcagttgccgcatccgaagcagttgccgcatccgaagcagttgccg

SEQ ID NO: 734781 - DNA, 3343 bp, Homo sapiens
gctccagctaagaggacaagatgaggcccggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtgtgtatgaaaagaaactgttaaacctaactgtccgaattgacatcatggagaaggataccatttcttacactgaactggacttcgagctgatcaaggtagaagtgaaggagatggaaaaactggtcatacagctgaaggagagttttggtggaagctcagaaattgttgaccagctggaggtggagataagaaatatgactctcttggtagagaagcttgagacactagacaaaaacaatgtccttgccattcgccgagaaatcgtggctctgaagaccaagctgaaagagtgtgaggcctctaaagatcaaaacacccctgtcgtccaccctcctcccactccagggagctgtggtcatggtggtgtggtgaacatcagcaaaccgtctgtggttcagctcaactggagagggttttcttatctatatggtgcttggggtagggattactctccccagcatccaaacaaaggactgtattgggtggcgccattgaatacagatgggagactgttggagtattatagactgtacaacacactggatgatttgctattgtatataaatgctcgagagttgcggatcacctatggccaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatggacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaagtcaacttttgttttatttaattttaatttttttttaaagctcttaacagggtagtccatatcttgctatgaggttgggagaatggctacctcccaaacactagtgcggggagattgcacacctaacaacagatcacatcaataacttttataagagcccagagttaggctggctctttcatttttctttccctttaaaatccactctttctggcagcttttattgtacatgactgccctattatcttttgggatatgaccttatgtacttattaatttgcatgactgatctgattatttccaatgctagactacatttatgtagcttatgttccttttccaattgagctatgaacatggatcagaagcctctggatcttccccagacaggaggacttgggcagaaagcaaaaggactaactggctataccaggaagagaagtacctttaccaaagagaatatgtaagaagacaggtgacctagagctggaaggacacagtgga

SEQ ID NO: 734782 - DNA, 3314 bp, Homo sapiens
cagtggtgagtacttgatagggcagagtcctacctggttggccagggaacaaaacgttgctggtctttccttcagagtggggttgttagacaactttgtctagaaacagtcactgtaaggaacaggtcaacgacaacttgggcaataggaactgaagagggaagctcagtcgctcctggaggagagccacagtccctaaggcaagttccctaactgtctgtgaaaagtagtattcagtaaaatgggggagagcactagaagtgctgtgaggcaaaggactgagggttgcttttcctccatggagcctccaaactctgtgtcatccacaaagactactttggtctcatctctttcaaggaagtaccaagtgggaaaccaaatattgggctttacaaagcacatttgagttaatgtttggcaggggatatctggatccaagggcagctcacagagtgggcctcactgacaaggtgtgggccatgactcagattcctgggtgtcctgaacctcctggggcagttcacacgttccctggccactccctcttttcctacatgctggccatggggaaatcaccactgggcactataagaagcccctgggctctctgcagagccagcgctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtgtgtatgaaaagaaactgttaaacctaactgtccgaattgacatcatggagaaggataccatttcttacactgaactggacttcgagctgatcaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatggacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaagtcaacttttgttttatttaattttaatttttttttaaagctcttaacagggtagtccatatcttgctatgaggttgggagaatggctacctcccaaacactagtgcggggagattgcacacctaacaacagatcacatcaataacttttataagagcccagagttaggctggctctttcatttttctttccctttaaaatccactctttctggcagcttttattgtacatgactgccctattatcttttgggatatgaccttatgtacttattaatttgcatgactgatctgattatttccaatgctagactacatttatgtagcttatgttccttttccaattgagctatgaacatggatcagaagcctctggatcttccccagacaggaggacttgggcagaaagcaaaaggactaactggctataccaggaagagaagtacctttaccaaagagaatatgtaagaagacaggtgacctagagctggaaggacacagtgga

SEQ ID NO: 734783 - DNA, 1564 bp, Homo sapiens
  misc_feature (59)..(59): n is a, c, g, or t
caattaggtgcatgagtaggtggctgcagtaatgttagcggttaggcgtacggccaggncatatggttgaatgagtaggctgatggtttcgttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatggacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaagtcaacttttgttttatttaattttaatttttttttaaagctcttaacagggtagtccatatcttgctatgaggttgggagaatggctacctcccaaacactagtgcggggagattgcacacctaacaacagatcacatcaataacttttataagagcccagagttaggctggctctttcatttttctttccctttaaaatccactctttctggcagcttttattgtacatgactgccctattatcttttgggatatgaccttatgtacttattaatttgcatgactgatctgattatttccaatgctagactacatttatgtagcttatgttccttttccaattgagctatgaacatggatcagaagcctctggatcttccccagacaggaggacttgggcagaaagcaaaaggactaactggctataccaggaagagaagtacctttaccaaagagaatatgtaagaagacaggtgacctagagctggaaggacacagtgga

SEQ ID NO: 734784 - DNA, 1739 bp, Homo sapiens
tagaggaccccattgatagcggtgagggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatggacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaagtcaacttttgttttatttaattttaatttttttttaaagctcttaacagggtagtccatatcttgctatgaggttgggagaatggctacctcccaaacactagtgcggggagattgcacacctaacaacagatcacatcaataacttttataagagcccagagttaggctggctctttcatttttctttccctttaaaatccactctttctggcagcttttattgtacatgactgccctattatcttttgggatatgaccttatgtacttattaatttgcatgactgatctgattatttccaatgctagactacatttatgtagcttatgttccttttccaattgagctatgaacatggatcagaagcctctggatcttccccagacaggaggacttgggcagaaagcaaaaggactaactggctataccaggaagagaagtacctttaccaaagagaatatgtaagaagacaggtgacctagagctggaaggacacagtgga

SEQ ID NO: 734785 - DNA, 3816 bp, Homo sapiens
cagtggtgagtacttgatagggcagagtcctacctggttggccagggaacaaaacgttgctggtctttccttcagagtggggttgttagacaactttgtctagaaacagtcactgtaaggaacaggtcaacgacaacttgggcaataggaactgaagagggaagctcagtcgctcctggaggagagccacagtccctaaggcaagttccctaactgtctgtgaaaagtagtattcagtaaaatgggggagagcactagaagtgctgtgaggcaaaggactgagggttgcttttcctccatggagcctccaaactctgtgtcatccacaaagactactttggtctcatctctttcaaggaagtaccaagtgggaaaccaaatattgggctttacaaagcacatttgagttaatgtttggcaggggatatctggatccaagggcagctcacagagtgggcctcactgacaaggtgtgggccatgactcagattcctgggtgtcctgaacctcctggggcagttcacacgttccctggccactccctcttttcctacatgctggccatggggaaatcaccactgggcactataagaagcccctgggctctctgcagagccagcgctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtgtgtatgaaaagaaactgttaaacctaactgtccgaattgacatcatggagaaggataccatttcttacactgaactggacttcgagctgatcaaggtagaagtgaaggagatggaaaaactggtcatacagctgaaggagagttttggtggaagctcagaaattgttgaccagctggaggtggagataagaaatatgactctcttggtagagaagcttgagacactagacaaaaacaatgtccttgccattcgccgagaaatcgtggctctgaagaccaagctgaaagagtgtgaggcctctaaagatcaaaacacccctgtcgtccaccctcctcccactccagggagctgtggtcatggtggtgtggtgaacatcagcaaaccgtctgtggttcagctcaactggagagggttttcttatctatatggtgcttggggtagggattactctccccagcatccaaacaaaggactgtattgggtggcgccattgaatacagatgggagactgttggagtattatagactgtacaacacactggatgatttgctattgtatataaatgctcgagagttgcggatcacctatggccaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatggacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaagtcaacttttgttttatttaattttaatttttttttaaagctcttaacagggtagtccatatcttgctatgaggttgggagaatggctacctcccaaacactagtgcggggagattgcacacctaacaacagatcacatcaataacttttataagagcccagagttaggctggctctttcatttttctttccctttaaaatccactctttctggcagcttttattgtacatgactgccctattatcttttgggatatgaccttatgtacttattaatttgcatgactgatctgattatttccaatgctagactacatttatgtagcttatgttccttttccaattgagctatgaacatggatcagaagcctctggatcttccccagacaggaggacttgggcagaaagcaaaaggactaactggctataccaggaagagaagtacctttaccaaagagaatatgtaagaagacaggtgacctagagctggaaggacacagtgga

SEQ ID NO: 734786 - DNA, 2841 bp, Homo sapiens
gctccagctaagaggacaagatgaggcccggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtgtgtatgaaaagaaactgttaaacctaactgtccgaattgacatcatggagaaggataccatttcttacactgaactggacttcgagctgatcaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatggacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaagtcaacttttgttttatttaattttaatttttttttaaagctcttaacagggtagtccatatcttgctatgaggttgggagaatggctacctcccaaacactagtgcggggagattgcacacctaacaacagatcacatcaataacttttataagagcccagagttaggctggctctttcatttttctttccctttaaaatccactctttctggcagcttttattgtacatgactgccctattatcttttgggatatgaccttatgtacttattaatttgcatgactgatctgattatttccaatgctagactacatttatgtagcttatgttccttttccaattgagctatgaacatggatcagaagcctctggatcttccccagacaggaggacttgggcagaaagcaaaaggactaactggctataccaggaagagaagtacctttaccaaagagaatatgtaagaagacaggtgacctagagctggaaggacacagtgga

SEQ ID NO: 734787 - DNA, 2985 bp, Homo sapiens
aacaaggtgcctattttggcaaagaattaatatagccctgggtcaagcaagatcacaaaagataaggcacttagacttcactgaattgtacccctctcctagctcccccgtacacacacgggatagcttttatcatattaatatttcattttggtacattaatgtaattgcttttcaaagagatagccctgtacctaatgttaataataatactgatatcttccatttattgggtacctgttacataccagacatcttgtaaaaattaatattaattcttaaaacaagttctgcaaggcagaactgtctcatttacaagtgtctgggccagaaggtatgctcctacctggctcacctgaataagtcgtctggctccacttactcagactgtgactgtatagagaattttattgagagaatttattacttcagtgttctcattaggaggaaatgccagaagaaactgagttcaagagagagaaacattgctaacaggaattagattcacaaggccaacagacaacccaaagtcattaagccatgagagtggaatgaatctatgaaaactcaatgaagacagaacaagagaaaaatcttttcagccacgatgaattaggagaacaagatgtcaaattacactgatgctgagtcaagcttctcaaagcaagagataatcaggctgacctattgctgaggactatgagaaaaaagttattacagaatgagtcatatggaaaacacttgcaaacagaagaatattgagaacataagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaattattaatttttccagggatatattttcaatcttttctatctctcctagtgactactatcattagtaggtgttgagcatatactgctgatttaatgacatacaaatcttcagcaaaaatatcacaggttaatcagctcccttctcacaagtagataacttacatgtgctgaaaaaggtaaaacattccatttaaaaagatctctgagggataacaagaggaaaaagaggtttcccttccataaacaaatattttaaatgacaagttctaagtgattcaagtttctcctatagtatagcaaaatattttttcattgggcggacgtgaaataaggttaacttcttaaaatgtattgaatggcaaaatatcttaacacatacaaatactttttaaatataaataaatatttaggaaatcaaatgttacagctgtaaggaaaataagtcccccttttaaaagcattgaagaaacacaaagcatgagtcattaa

SEQ ID NO: 734788 - DNA, 2332 bp, Homo sapiens
  misc_feature (2302)..(2302): n is a, c, g, or t
aacaaggtgcctattttggcaaagaattaatatagccctgggtcaagcaagatcacaaaagataaggcacttagacttcactgaattgtacccctctcctagctcccccgtacacacacgggatagcttttatcatattaatatttcattttggtacattaatgtaattgcttttcaaagagatagccctgtacctaatgttaataataatactgatatcttccatttattgggtacctgttacataccagacatcttgtaaaaattaatattaattcttaaaacaagttctgcaaggcagaactgtctcatttacaagtgtctgggccagaaggtatgctcctacctggctcacctgaataagtcgtctggctccacttactcagactgtgactgtatagagaattttattgagagaatttattacttcagtgttctcattaggaggaaatgccagaagaaactgagttcaagagagagaaacattgctaacaggaattagattcacaaggccaacagacaacccaaagtcattaagccatgagagtggaatgaatctatgaaaactcaatgaagacagaacaagagaaaaatcttttcagccacgatgaattaggagaacaagatgtcaaattacactgatgctgagtcaagcttctcaaagcaagagataatcaggctgacctattgctgaggactatgagaaaaaagttattacagaatgagtcatatggaaaacacttgcaaacagaagaatattgagaacataagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgccgggagggagnattcagccgggaggagcattcagccgggag

SEQ ID NO: 734789 - DNA, 1851 bp, Homo sapiens
  misc_feature (1851)..(1851): n is a, c, g, or t
aacaaggtgcctattttggcaaagaattaatatagccctgggtcaagcaagatcacaaaagataaggcacttagacttcactgaattgtacccctctcctagctcccccgtacacacacgggatagcttttatcatattaatatttcattttggtacattaatgtaattgcttttcaaagagatagccctgtacctaatgttaataataatactgatatcttccatttattgggtacctgttacataccagacatcttgtaaaaattaatattaattcttaaaacaagttctgcaaggcagaactgtctcatttacaagtgtctgggccagaaggtatgctcctacctggctcacctgaataagtcgtctggctccacttactcagactgtgactgtatagagaattttattgagagaatttattacttcagtgttctcattaggaggaaatgccagaagaaactgagttcaagagagagaaacattgctaacaggaattagattcacaaggccaacagacaacccaaagtcattaagccatgagagtggaatgaatctatgaaaactcaatgaagacagaacaagagaaaaatcttttcagccacgatgaattaggagaacaagatgtcaaattacactgatgctgagtcaagcttctcaaagcaagagataatcaggctgacctattgctgaggactatgagaaaaaagttattacagaatgagtcatatggaaaacacttgcaaacagaagaatattgagaacataagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaaaaaaaaaaaaacaaccaaaaaaaaaaaaagggcgcggctaaaaatccgggggcccatttcctctccccttttttaagggcccaaaggaattaaaaaggcggcggtaaacggacgggaacccccggcttggggaaccctttcgggcttgggacccccaaagccgaaaatgttgtaccgctcggatcgtaacaagn

SEQ ID NO: 734790 - DNA, 2900 bp, Homo sapiens
aacaaggtgcctattttggcaaagaattaatatagccctgggtcaagcaagatcacaaaagataaggcacttagacttcactgaattgtacccctctcctagctcccccgtacacacacgggatagcttttatcatattaatatttcattttggtacattaatgtaattgcttttcaaagagatagccctgtacctaatgttaataataatactgatatcttccatttattgggtacctgttacataccagacatcttgtaaaaattaatattaattcttaaaacaagttctgcaaggcagaactgtctcatttacaagtgtctgggccagaaggtatgctcctacctggctcacctgaataagtcgtctggctccacttactcagactgtgactgtatagagaattttattgagagaatttattacttcagtgttctcattaggaggaaatgccagaagaaactgagttcaagagagagaaacattgctaacaggaattagattcacaaggccaacagacaacccaaagtcattaagccatgagagtggaatgaatctatgaaaactcaatgaagacagaacaagagaaaaatcttttcagccacgatgaattaggagaacaagatgtcaaattacactgatgctgagtcaagcttctcaaagcaagagataatcaggctgacctattgctgaggactatgagaaaaaagttattacagaatgagtcatatggaaaacacttgcaaacagaagaatattgagaacataagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaattattaatttttccagggatatattttcaatcttttctatctctcctagtgactactatcattagtaggtgttgagcatatactgctgatttaatgacatacaaatcttcagcaaaaatatcacaggttaatcagctcccttctcacaagtagataacttacatgtgctgaaaaaggtaaaacattccatttaaaaagatctctgagggataacaagaggaaaaagaggtttcccttccataaacaaatattttaaatgacaagttctaagtgattcaagtttctcctatagtatagcaaaatattttttcattgggcggacgtgaaataaggttaacttcttaaaatgtattgaatggcaaaatatcttaacacatacaaatactttttaaatataaataaatatttaggaaatcaaatgttacagctgtaaggaaaataagtcccccttttaaaagcattgaagaaacacaaagcatgagtcattaa

SEQ ID NO: 734791 - DNA, 2247 bp, Homo sapiens
  misc_feature (2217)..(2217): n is a, c, g, or t
aacaaggtgcctattttggcaaagaattaatatagccctgggtcaagcaagatcacaaaagataaggcacttagacttcactgaattgtacccctctcctagctcccccgtacacacacgggatagcttttatcatattaatatttcattttggtacattaatgtaattgcttttcaaagagatagccctgtacctaatgttaataataatactgatatcttccatttattgggtacctgttacataccagacatcttgtaaaaattaatattaattcttaaaacaagttctgcaaggcagaactgtctcatttacaagtgtctgggccagaaggtatgctcctacctggctcacctgaataagtcgtctggctccacttactcagactgtgactgtatagagaattttattgagagaatttattacttcagtgttctcattaggaggaaatgccagaagaaactgagttcaagagagagaaacattgctaacaggaattagattcacaaggccaacagacaacccaaagtcattaagccatgagagtggaatgaatctatgaaaactcaatgaagacagaacaagagaaaaatcttttcagccacgatgaattaggagaacaagatgtcaaattacactgatgctgagtcaagcttctcaaagcaagagataatcaggctgacctattgctgaggactatgagaaaaaagttattacagaatgagtcatatggaaaacacttgcaaacagaagaatattgagaacataagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgccgggagggagnattcagccgggaggagcattcagccgggag

SEQ ID NO: 734792 - DNA, 1766 bp, Homo sapiens
  misc_feature (1766)..(1766): n is a, c, g, or t
aacaaggtgcctattttggcaaagaattaatatagccctgggtcaagcaagatcacaaaagataaggcacttagacttcactgaattgtacccctctcctagctcccccgtacacacacgggatagcttttatcatattaatatttcattttggtacattaatgtaattgcttttcaaagagatagccctgtacctaatgttaataataatactgatatcttccatttattgggtacctgttacataccagacatcttgtaaaaattaatattaattcttaaaacaagttctgcaaggcagaactgtctcatttacaagtgtctgggccagaaggtatgctcctacctggctcacctgaataagtcgtctggctccacttactcagactgtgactgtatagagaattttattgagagaatttattacttcagtgttctcattaggaggaaatgccagaagaaactgagttcaagagagagaaacattgctaacaggaattagattcacaaggccaacagacaacccaaagtcattaagccatgagagtggaatgaatctatgaaaactcaatgaagacagaacaagagaaaaatcttttcagccacgatgaattaggagaacaagatgtcaaattacactgatgctgagtcaagcttctcaaagcaagagataatcaggctgacctattgctgaggactatgagaaaaaagttattacagaatgagtcatatggaaaacacttgcaaacagaagaatattgagaacataagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaaaaaaaaaaaaacaaccaaaaaaaaaaaaagggcgcggctaaaaatccgggggcccatttcctctccccttttttaagggcccaaaggaattaaaaaggcggcggtaaacggacgggaacccccggcttggggaaccctttcgggcttgggacccccaaagccgaaaatgttgtaccgctcggatcgtaacaagn

SEQ ID NO: 734793 - DNA, 1305 bp, Homo sapiens
aacaaggtgcctattttggcaaagaattaatatagccctgggtcaagcaagatcacaaaagataaggcacttagacttcactgaattgtacccctctcctagctcccccgtacacacacgggatagcttttatcatattaatatttcattttggtacattaatgtaattgcttttcaaagagatagccctgtacctaatgttaataataatactgatatcttccatttattgggtacctgttacataccagacatcttgtaaaaattaatattaattcttaaaacaagttctgcaaggcagaactgtctcatttacaagtgtctgggccagaaggtatgctcctacctggctcacctgaataagtcgtctggctccacttactcagactgtgactgtatagagaattttattgagagaatttattacttcagtgttctcattaggaggaaatgccagaagaaactgagttcaagagagagaaacattgctaacaggaattagattcacaaggccaacagacaacccaaagtcattaagccatgagagtggaatgaatctatgaaaactcaatgaagacagaacaagagaaaaatcttttcagccacgatgaattaggagaacaagatgtcaaattacactgatgctgagtcaagcttctcaaagcaagagataatcaggctgacctattgctgaggactatgagaaaaaagttattacagaatgagtcatatggaaaacacttgcaaacagaagaatattgagaacataagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctcagctctggcaagagctctgccaagggg

SEQ ID NO: 734794 - DNA, 4000 bp, Homo sapiens
gtacgtgttattctctcattggtacttaacattaaggataaaacataaaaagcagggtaaagcatcccaaaataatctgtgaaagcaataagtgattctgcttctttaagtaacaatatggcaggttttttttgaaaacccaaggttacccaaactctgacctttgaaaccaattcctccatttggagaaacaatacaataaaaccaactggtataaaagacaagcacaagcccattcactagaggcaagtttggaatcatagatcacagaaaaagtagtttggccttcctagaaatatattcaattacatgcacacaaaaggtgaggtcttggaaagttacttattactatttgaaagatgagaaaaatataatcataatagtattttcttttgagcctatttaataataaagtgtgtattctgttgtgaatttaaaatattataatttggggggttttgcctgttagaaaaaacttcataaactgaagtattatattacatgttgtagtataccacgtgctatatttaccaagttaatattgatatgtaatacacttattatttccataatatgttggttttttatttactaatgttccttatgaaacacctgccttttcagtatacagatgactagataatgagatagaaaattctagatctagtcatgaccacaagataactgtttacatttgataataactatgtaatagttttcaaaggaataaggtttaaaaaaaaagaatcagaagaaatttcatggaacttagtcaaggtaaagctgtcttacaaggtggaattaggccttttttttaagtcacttccatgcttaaggaagaatgacatcttctgacagcatctctgtttattcagtgctccacccgaaggagtgtatttatcatctaacaatattgactctagggtcagactcgaactgctaaggacacgtcgtcttaatctgtacaaaatctgcctttcatatatggtgaaagtagttactgaacccaatttgttttttaatgcactgtttgtagcctattcaacctcattagcagcatatcatttcgatggaaaattcttattgactgagattactcactgcaaattctaaaagaaagatcttaatgtctgctttataaatacccatcttctaaaagataagagttcgtggggaaatcacttaataactctaggtgttattacattttaaattactttttattcctcctcctctacaaagcacacctccaccatgatgtaaaagaattttaggctgtgggactttattcagagcaaacaagggatttgaatggctgtgagactaggattccttccagcttagtacagggtataaaatttctgctcaccaggaagaaagattagattatgctgtaaaacaagtgtggagagttacatgccaaatctcaagctgtgggctccttgagaatggctaagcatagaaacttgaacacaagagcaaacgtttgagggtttataaatccctcaaagagatcctaggattgggttcagtatataagtgaaccctctgaagtaactgtaaaattttgcatatgcctatatatgtgtatcttacctgcagataaattcaatagatttcatcatccagatcatgtaacttattgtccaaatcatggtacttttgagaatgaaagaagacattctcaattattatacccagcaacaggcttaaactgaggctctcctgggcaaactgagaagtataatcacctcattcatgaccccaaaaggtaatacactactgcaccagaacacttagcttttcattatttcaacccaagaacccttcatgaattttcgtttaaagccactgatttttatacaatcagtgtattctcctagtgtctagttacaagtctcgccgcatttggcaccagttgttgccttgagatttgtagctcctactggacttggatccagggctatgacactatcctgcctgtcctcacactttatactttctgtgctctgcaagtatttcttttcctcactcctaaatggacaatcattaccaaagttgtatgctggtccttttgctctatactttcccgcaagaaacacatctaattgtatgacattaagtttaacatatcaatgactggttctcagcctttgacacatatcatggtcccaaactttagacccaggaaccttcatccacccaagcagtaaatctgctcctccatcactagtctcaggaaagaatacaaagaagagtaaagctgataagcttactcaaagaaaggttttgctaattatgtttgcaaatctgctctgttgggcatttagaaagtttaagagaattagatatataagtacagtttaaactatttttaacaatttcattactggatatcaattaaaactccagaaactctaaaccattctgtgcacaaaagcccaattcagaaattaaaataaattcaaatggtaaccaagttttcctctgtcaaaacacaaatttttatgtgtccatttctctaagctagagttagggagaatttattcagctatttggtcagcagttagatatgtttttgacaagtcttctctgaggcaaaccctttgagtacaagaagtcatttgcacttccctctgcataaggctcataataattcagtaatgtggaattctatgcatctacaggcttatctcattatttcctgacatcagaaggcagcctgatggactgaaagaaatactggattaattatcaccaactatggaaaattttagatcttctctctgttcatcaattttgtggctttgcgctaattatgtccactcacctgagcctttttacttttttaaaagaaaataatgaagtctggtgagattgttataatgacaaatgaatatttccaatgaatatatgtgaaaagtttaagacttgtgataggctataatcaaagggtaatccaacaaagattctgctgtcatagactgagacctaaatgatcataatacagagaagtaatacattctgtattactaactaatatttttgagtgcttactatgtgttatgtaccattctaagcactttatgtctattatcttatgtaatcttccacagatcctatatagtaaaaaagtagggataggaagacctacaagtgagacaactaaagcacagagaagttaagtaagttgcctggattagtagagtatgtaacagtcaggaaacttgattcaaactcgaacctatctgaatctacagcttgccctcttaaccctcacatgcttcctcttgagggtaaagtctaaacttagaatggcattaaaggcccaggcaaatagccccaaaacacccctccaaccctattgtctatgagctacccagatgtctctcacttcagctaggctcgtccttaaatatcccacaaatatattttgcaaattctatatcaccgtctctatttggaaatcttgctttctgccgtcaagttgagcactctagtaggtagcaatctctactctctctgaaaaataatcacacctgacgtctatcccacttacttgtttcttgttgcgtgccattctcatgtgaatggctaatttttagtgttgttccatcttaattcttcaatcagatcgtaagtaaccttagagtagaaacagtgttgtaaactgctacatgttttccccatagcatggcccatcactccgaattgcaattatctatgtgtgtgtctggctacctcaataactgaccatcattttttcatttttatatatttaatgcctggcacaatatttgctacataaacagagttgatgaatacttggtgaagaaaataaatgaatgagtaaatgaaacacaagagttagctactcatgcatgctagattacacaataattgccagttataagtctcctgttttaactcaaaaataggatataatccactttaaaatatgcttgaatatggatgcagctggaggtcattatcctaatca

SEQ ID NO: 734795 - DNA, 4000 bp, Homo sapiens; identical to SEQ ID NO: 734794

SEQ ID NO: 734796 - DNA, 4000 bp, Homo sapiens; identical to SEQ ID NO: 734794

SEQ ID NO: 734797 - DNA, 4000 bp, Homo sapiens; identical to SEQ ID NO: 734794

SEQ ID NO: 734798 - DNA, 4000 bp, Homo sapiens; identical to SEQ ID NO: 734794

SEQ ID NO: 734799 - DNA, 4000 bp, Homo sapiens; identical to SEQ ID NO: 734794

SEQ ID NO: 734800 - DNA, 4000 bp, Homo sapiens; identical to SEQ ID NO: 734794

SEQ ID NO: 734801 - DNA, 4000 bp, Homo sapiens; identical to SEQ ID NO: 734794

SEQ ID NO: 734802 - DNA, 4000 bp, Homo sapiens; identical to SEQ ID NO: 734794

SEQ ID NO: 734803 - DNA, 4000 bp, Homo sapiens; identical to SEQ ID NO: 734794

SEQ ID NO: 734804 - DNA, 4000 bp, Homo sapiens; identical to SEQ ID NO: 734794

SEQ ID NO: 734805 - DNA, 4000 bp, Homo sapiens; identical to SEQ ID NO: 734794

SEQ ID NO: 734806 - DNA, 4000 bp, Homo sapiens; identical to SEQ ID NO: 734794

SEQ ID NO: 734807 - DNA, 4000 bp, Homo sapiens; identical to SEQ ID NO: 734794

SEQ ID NO: 734808 - DNA, 1909 bp, Homo sapiens
tagaggatcccctctatcctataatcggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaattattaatttttccagggatatattttcaatcttttctatctctcctagtgactactatcattagtaggtgttgagcatatactgctgatttaatgacatacaaatcttcagcaaaaatatcacaggttaatcagctcccttctcacaagtagataacttacatgtgctgaaaaaggtaaaacattccatttaaaaagatctctgagggataacaagaggaaaaagaggtttcccttccataaacaaatattttaaatgacaagttctaagtgattcaagtttctcctatagtatagcaaaatattttttcattgggcggacgtgaaataaggttaacttcttaaaatgtattgaatggcaaaatatcttaacacatacaaatactttttaaatataaataaatatttaggaaatcaaatgttacagctgtaaggaaaataagtcccccttttaaaagcattgaagaaacacaaagcatgagtcattaa

SEQ ID NO: 734809 - DNA, 1256 bp, Homo sapiens
  misc_feature (1226)..(1226): n is a, c, g, or t
tagaggatcccctctatcctataatcggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgccgggagggagnattcagccgggaggagcattcagccgggag

SEQ ID NO: 734810 - DNA, 775 bp, Homo sapiens
  misc_feature (775)..(775): n is a, c, g, or t
tagaggatcccctctatcctataatcggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaaaaaaaaaaaaacaaccaaaaaaaaaaaaagggcgcggctaaaaatccgggggcccatttcctctccccttttttaagggcccaaaggaattaaaaaggcggcggtaaacggacgggaacccccggcttggggaaccctttcgggcttgggacccccaaagccgaaaatgttgtaccgctcggatcgtaacaagn

SEQ ID NO: 734811 - DNA, 1824 bp, Homo sapiens
tagaggatcccctctatcctataatcggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaattattaatttttccagggatatattttcaatcttttctatctctcctagtgactactatcattagtaggtgttgagcatatactgctgatttaatgacatacaaatcttcagcaaaaatatcacaggttaatcagctcccttctcacaagtagataacttacatgtgctgaaaaaggtaaaacattccatttaaaaagatctctgagggataacaagaggaaaaagaggtttcccttccataaacaaatattttaaatgacaagttctaagtgattcaagtttctcctatagtatagcaaaatattttttcattgggcggacgtgaaataaggttaacttcttaaaatgtattgaatggcaaaatatcttaacacatacaaatactttttaaatataaataaatatttaggaaatcaaatgttacagctgtaaggaaaataagtcccccttttaaaagcattgaagaaacacaaagcatgagtcattaa

SEQ ID NO: 734812 - DNA, 1171 bp, Homo sapiens
  misc_feature (1141)..(1141): n is a, c, g, or t
tagaggatcccctctatcctataatcggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgccgggagggagnattcagccgggaggagcattcagccgggag

SEQ ID NO: 734813 - DNA, 690 bp, Homo sapiens
  misc_feature (690)..(690): n is a, c, g, or t
tagaggatcccctctatcctataatcggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaaaaaaaaaaaaacaaccaaaaaaaaaaaaagggcgcggctaaaaatccgggggcccatttcctctccccttttttaagggcccaaaggaattaaaaaggcggcggtaaacggacgggaacccccggcttggggaaccctttcgggcttgggacccccaaagccgaaaatgttgtaccgctcggatcgtaacaagn

SEQ ID NO: 734814 - DNA, 229 bp, Homo sapiens
tagaggatcccctctatcctataatcggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctcagctctggcaagagctctgccaagggg

SEQ ID NO: 734815 - DNA, 1991 bp, Homo sapiens
gctcggtaccccacacgccgaggctccagacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaattattaatttttccagggatatattttcaatcttttctatctctcctagtgactactatcattagtaggtgttgagcatatactgctgatttaatgacatacaaatcttcagcaaaaatatcacaggttaatcagctcccttctcacaagtagataacttacatgtgctgaaaaaggtaaaacattccatttaaaaagatctctgagggataacaagaggaaaaagaggtttcccttccataaacaaatattttaaatgacaagttctaagtgattcaagtttctcctatagtatagcaaaatattttttcattgggcggacgtgaaataaggttaacttcttaaaatgtattgaatggcaaaatatcttaacacatacaaatactttttaaatataaataaatatttaggaaatcaaatgttacagctgtaaggaaaataagtcccccttttaaaagcattgaagaaacacaaagcatgagtcattaa

SEQ ID NO: 734816 - DNA, 1338 bp, Homo sapiens
  misc_feature (1308)..(1308): n is a, c, g, or t
gctcggtaccccacacgccgaggctccagacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgccgggagggagnattcagccgggaggagcattcagccgggag

SEQ ID NO: 734817 - DNA, 857 bp, Homo sapiens
  misc_feature (857)..(857): n is a, c, g, or t
gctcggtaccccacacgccgaggctccagacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaaaaaaaaaaaaacaaccaaaaaaaaaaaaagggcgcggctaaaaatccgggggcccatttcctctccccttttttaagggcccaaaggaattaaaaaggcggcggtaaacggacgggaacccccggcttggggaaccctttcgggcttgggacccccaaagccgaaaatgttgtaccgctcggatcgtaacaagn

SEQ ID NO: 734818 - DNA, 1906 bp, Homo sapiens
gctcggtaccccacacgccgaggctccagacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaattattaatttttccagggatatattttcaatcttttctatctctcctagtgactactatcattagtaggtgttgagcatatactgctgatttaatgacatacaaatcttcagcaaaaatatcacaggttaatcagctcccttctcacaagtagataacttacatgtgctgaaaaaggtaaaacattccatttaaaaagatctctgagggataacaagaggaaaaagaggtttcccttccataaacaaatattttaaatgacaagttctaagtgattcaagtttctcctatagtatagcaaaatattttttcattgggcggacgtgaaataaggttaacttcttaaaatgtattgaatggcaaaatatcttaacacatacaaatactttttaaatataaataaatatttaggaaatcaaatgttacagctgtaaggaaaataagtcccccttttaaaagcattgaagaaacacaaagcatgagtcattaa

SEQ ID NO: 734819 - DNA, 1253 bp, Homo sapiens
  misc_feature (1223)..(1223): n is a, c, g, or t
gctcggtaccccacacgccgaggctccagacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgccgggagggagnattcagccgggaggagcattcagccgggag

SEQ ID NO: 734820 - DNA, 772 bp, Homo sapiens
  misc_feature (772)..(772): n is a, c, g, or t
gctcggtaccccacacgccgaggctccagacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaaaaaaaaaaaaacaaccaaaaaaaaaaaaagggcgcggctaaaaatccgggggcccatttcctctccccttttttaagggcccaaaggaattaaaaaggcggcggtaaacggacgggaacccccggcttggggaaccctttcgggcttgggacccccaaagccgaaaatgttgtaccgctcggatcgtaacaagn

SEQ ID NO: 734821 - DNA, 311 bp, Homo sapiens
gctcggtaccccacacgccgaggctccagacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctcagctctggcaagagctctgccaagggg

SEQ ID NO: 734822 - DNA, 2038 bp, Homo sapiens
tccaggggcaataagagctactccagcccaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaattattaatttttccagggatatattttcaatcttttctatctctcctagtgactactatcattagtaggtgttgagcatatactgctgatttaatgacatacaaatcttcagcaaaaatatcacaggttaatcagctcccttctcacaagtagataacttacatgtgctgaaaaaggtaaaacattccatttaaaaagatctctgagggataacaagaggaaaaagaggtttcccttccataaacaaatattttaaatgacaagttctaagtgattcaagtttctcctatagtatagcaaaatattttttcattgggcggacgtgaaataaggttaacttcttaaaatgtattgaatggcaaaatatcttaacacatacaaatactttttaaatataaataaatatttaggaaatcaaatgttacagctgtaaggaaaataagtcccccttttaaaagcattgaagaaacacaaagcatgagtcattaa

SEQ ID NO: 734823 - DNA, 1385 bp, Homo sapiens
  misc_feature (1355)..(1355): n is a, c, g, or t
tccaggggcaataagagctactccagcccaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgccgggagggagnattcagccgggaggagcattcagccgggag

SEQ ID NO: 734824 - DNA, 904 bp, Homo sapiens
  misc_feature (904)..(904): n is a, c, g, or t
tccaggggcaataagagctactccagcccaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaaaaaaaaaaaaacaaccaaaaaaaaaaaaagggcgcggctaaaaatccgggggcccatttcctctccccttttttaagggcccaaaggaattaaaaaggcggcggtaaacggacgggaacccccggcttggggaaccctttcgggcttgggacccccaaagccgaaaatgttgtaccgctcggatcgtaacaagn

SEQ ID NO: 734825 - DNA, 1953 bp, Homo sapiens
tccaggggcaataagagctactccagcccaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaattattaatttttccagggatatattttcaatcttttctatctctcctagtgactactatcattagtaggtgttgagcatatactgctgatttaatgacatacaaatcttcagcaaaaatatcacaggttaatcagctcccttctcacaagtagataacttacatgtgctgaaaaaggtaaaacattccatttaaaaagatctctgagggataacaagaggaaaaagaggtttcccttccataaacaaatattttaaatgacaagttctaagtgattcaagtttctcctatagtatagcaaaatattttttcattgggcggacgtgaaataaggttaacttcttaaaatgtattgaatggcaaaatatcttaacacatacaaatactttttaaatataaataaatatttaggaaatcaaatgttacagctgtaaggaaaataagtcccccttttaaaagcattgaagaaacacaaagcatgagtcattaa

SEQ ID NO: 734826 - DNA, 1300 bp, Homo sapiens
  misc_feature (1270)..(1270): n is a, c, g, or t
tccaggggcaataagagctactccagcccaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgccgggagggagnattcagccgggaggagcattcagccgggag

SEQ ID NO: 734827 - DNA, 819 bp, Homo sapiens
  misc_feature (819)..(819): n is a, c, g, or t
tccaggggcaataagagctactccagcccaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaaaaaaaaaaaaacaaccaaaaaaaaaaaaagggcgcggctaaaaatccgggggcccatttcctctccccttttttaagggcccaaaggaattaaaaaggcggcggtaaacggacgggaacccccggcttggggaaccctttcgggcttgggacccccaaagccgaaaatgttgtaccgctcggatcgtaacaagn

SEQ ID NO: 734828 - DNA, 358 bp, Homo sapiens
tccaggggcaataagagctactccagcccaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctcagctctggcaagagctctgccaagggg

SEQ ID NO: 734829 - DNA, 2885 bp, Homo sapiens
  misc_feature (2692)..(2694): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaacaaaaaacaaaacaaacaaaaaaaaacaaannncgcgggctaaaatcccgggggcagtacgtccccttttggcacgggcctagagggataaaaagacccgggacaacgcggaggaagcggcggcttggcgccttctgggtgacgaaacccagagttcccgcaacgttgtgaccttggtgtatacatcttagcgcggacatactctcacgcactcacctcacatc

SEQ ID NO: 734830 - DNA, 2805 bp, Homo sapiens
  misc_feature (2678)..(2678): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacatacanaaaaaaaagggggggttttttggggggggggaaaaagggttttgaagggaaggggtaagggtttctggacccgttttgttaaagggggaaatgggggccccaagggggggaaaaaggaagggggacg

SEQ ID NO: 734831 - DNA, 3071 bp, Homo sapiens
  misc_feature (2685)..(2685): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaatttgggggtctggtggtgtgcgggtggaatggcctgtgagtccctctagctgtccttaacctgcagcccaaattatccacttgtggaggggatcttgggggcatcctggagccccaggagtcccggggaagaaaggctgggagctggagaagaggaggagaagcaatgcccagcctcatagctgcttgcttacacactcacaccccagctgcacctggctcccaaacactcctcgcctacccacgtttcctcacacacactcacacccgaatcatacagaggtgtgctttcaaatgcacacacacatacattcactcagcaaataggtgcagactccccaaaacaaacccagtctctgatcccacatgaagggatcctctaga

SEQ ID NO: 734832 - DNA, 3360 bp, Homo sapiens
  misc_feature (2685)..(2685): n is a, c, g, or t
  misc_feature (2699)..(2699): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaaaaaaaaaaaanaaaaaaaaaaaaaaaaaaaaaaaaaaaacaacaagcagccacaagaaaacccaaccaacgagacaaaacaaaaacagcaacaaaaaaaaaagaacagagccgcggcgccggctgcacacatacacatcgcagggcggcgccccagcaccacagcaccccccacgcctatacaggagcggcggcccaccaacccggcccagctcctactaacacggacgcccgggccggccacaccccaccggcacggccgaacaccaaccacccagcaggcaatgtggcggcacccccacccgtggcgcgagtacagatcaggccagcacgaacccacccaatcagcagtaatggcgctacggagtactaaaatataagaggagcgctgcaagaaccacccacaccatctcgtcgggcagccagaacgccccgcgacgaccgcagactacatccatccacgggcggacggccaacagagtccgaggctggcgacgacgtcggacggcccgcggcaccgaggcgtcgacgaaacgacgccggaagacacactgcgagcaggcgaccagactgcagccccacgcccatcatggacacaagcgactcggacgacgcacgccatagatcaggtcccagaccaccttaacccagacggacagcgcggagacaagca

SEQ ID NO: 734833 - DNA, 3261 bp, Homo sapiens
  misc_feature (2685)..(2685): n is a, c, g, or t
  misc_feature (2699)..(2699): n is a, c, g, or t
  misc_feature (3261)..(3261): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaaaaaaaaaaaanaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 734834 - DNA, 2694 bp, Homo sapiens
  misc_feature (2662)..(2662): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaanggaaaaggcagcagacagaagaaaaagttttg

SEQ ID NO: 734835 - DNA, 3333 bp, Homo sapiens
  misc_feature (2672)..(2672): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaanaaaaaaaaaaaaaaaaaaaaaaaaaaaacaacaagcagccacaagaaaacccaaccaacgagacaaaacaaaaacagcaacaaaaaaaaaagaacagagccgcggcgccggctgcacacatacacatcgcagggcggcgccccagcaccacagcaccccccacgcctatacaggagcggcggcccaccaacccggcccagctcctactaacacggacgcccgggccggccacaccccaccggcacggccgaacaccaaccacccagcaggcaatgtggcggcacccccacccgtggcgcgagtacagatcaggccagcacgaacccacccaatcagcagtaatggcgctacggagtactaaaatataagaggagcgctgcaagaaccacccacaccatctcgtcgggcagccagaacgccccgcgacgaccgcagactacatccatccacgggcggacggccaacagagtccgaggctggcgacgacgtcggacggcccgcggcaccgaggcgtcgacgaaacgacgccggaagacacactgcgagcaggcgaccagactgcagccccacgcccatcatggacacaagcgactcggacgacgcacgccatagatcaggtcccagaccaccttaacccagacggacagcgcggagacaagca

SEQ ID NO: 734836 - DNA, 3234 bp, Homo sapiens
  misc_feature (2672)..(2672): n is a, c, g, or t
  misc_feature (3234)..(3234): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaanaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 734837 - DNA, 2817 bp, Homo sapiens
  misc_feature (2673)..(2673): n is a, c, g, or t
  misc_feature (2688)..(2689): n is a, c, g, or t
  misc_feature (2697)..(2697): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaaanaaagaaaaacaaaannaaaaaaanaaaaagactattccaaaagaaagaactaggagtgggcccgtaccccaaaataaaaaacctcggggggggccccgtgcccaatttcgcccttatggagagcctttaacattcaaatgggcc

SEQ ID NO: 734838 - DNA, 2928 bp, Homo sapiens
  misc_feature (2673)..(2673): n is a, c, g, or t
  misc_feature (2688)..(2689): n is a, c, g, or t
  misc_feature (2697)..(2697): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaaanaaagaaaaacaaaannaaaaaaanaaaaaaaaaaagcaaaaaaaaaaccgcgcagaggatttcatgtgggggggggggaagaaaaagagaggatgaaaagaagagggagccgaggtggtgaccaatatggtggtgtgccgagaccacatttttttgttaaaaagagggggagaaaaagagggggggcctcccattaataggggagggagggattatatttgggagagagccgaggggagagccgggttattaagg

SEQ ID NO: 734839 - DNA, 2627 bp, Homo sapiens
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatggggccattcaacgcctccgggccattgaacgcctccg

SEQ ID NO: 734840 - DNA, 2615 bp, Homo sapiens
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgattgggccaggggggggtaccgagg

SEQ ID NO: 734841 - DNA, 2488 bp, Homo sapiens
  misc_feature (2456)..(2456): n is a, c, g, or t
  misc_feature (2469)..(2469): n is a, c, g, or t
  misc_feature (2473)..(2473): n is a, c, g, or t
  misc_feature (2488)..(2488): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctaccccnggggcctccgaanaagnaaaagctcgaattgn

SEQ ID NO: 734842 - DNA, 2912 bp, Homo sapiens
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtcgcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaacaaacacaaaacaacacacacaacaaacaacaaaaaacaacaaccacacacacaaacacacacaaccaagagagggggcgcgcgccgccaaaaagagagagaccacccccaggggggcgcacgcaaacacagcagcgaacccccacgctgtggagcacaaaagggg

SEQ ID NO: 734843 - DNA, 2857 bp, Homo sapiens
  misc_feature (2664)..(2666): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaacaaaaaacaaaacaaacaaaaaaaaacaaannncgcgggctaaaatcccgggggcagtacgtccccttttggcacgggcctagagggataaaaagacccgggacaacgcggaggaagcggcggcttggcgccttctgggtgacgaaacccagagttcccgcaacgttgtgaccttggtgtatacatcttagcgcggacatactctcacgcactcacctcacatc

SEQ ID NO: 734844 - DNA, 2777 bp, Homo sapiens
  misc_feature (2650)..(2650): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacatacanaaaaaaaagggggggttttttggggggggggaaaaagggttttgaagggaaggggtaagggtttctggacccgttttgttaaagggggaaatgggggccccaagggggggaaaaaggaagggggacg

SEQ ID NO: 734845 - DNA, 3043 bp, Homo sapiens
  misc_feature (2657)..(2657): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaatttgggggtctggtggtgtgcgggtggaatggcctgtgagtccctctagctgtccttaacctgcagcccaaattatccacttgtggaggggatcttgggggcatcctggagccccaggagtcccggggaagaaaggctgggagctggagaagaggaggagaagcaatgcccagcctcatagctgcttgcttacacactcacaccccagctgcacctggctcccaaacactcctcgcctacccacgtttcctcacacacactcacacccgaatcatacagaggtgtgctttcaaatgcacacacacatacattcactcagcaaataggtgcagactccccaaaacaaacccagtctctgatcccacatgaagggatcctctaga

SEQ ID NO: 734846 - DNA, 3332 bp, Homo sapiens
  misc_feature (2657)..(2657): n is a, c, g, or t
  misc_feature (2671)..(2671): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaaaaaaaaaaaanaaaaaaaaaaaaaaaaaaaaaaaaaaaacaacaagcagccacaagaaaacccaaccaacgagacaaaacaaaaacagcaacaaaaaaaaaagaacagagccgcggcgccggctgcacacatacacatcgcagggcggcgccccagcaccacagcaccccccacgcctatacaggagcggcggcccaccaacccggcccagctcctactaacacggacgcccgggccggccacaccccaccggcacggccgaacaccaaccacccagcaggcaatgtggcggcacccccacccgtggcgcgagtacagatcaggccagcacgaacccacccaatcagcagtaatggcgctacggagtactaaaatataagaggagcgctgcaagaaccacccacaccatctcgtcgggcagccagaacgccccgcgacgaccgcagactacatccatccacgggcggacggccaacagagtccgaggctggcgacgacgtcggacggcccgcggcaccgaggcgtcgacgaaacgacgccggaagacacactgcgagcaggcgaccagactgcagccccacgcccatcatggacacaagcgactcggacgacgcacgccatagatcaggtcccagaccaccttaacccagacggacagcgcggagacaagca

SEQ ID NO: 734847 - DNA, 3233 bp, Homo sapiens
  misc_feature (2657)..(2657): n is a, c, g, or t
  misc_feature (2671)..(2671): n is a, c, g, or t
  misc_feature (3233)..(3233): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaaaaaaaaaaaanaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 734848 - DNA, 2666 bp, Homo sapiens
  misc_feature (2634)..(2634): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaanggaaaaggcagcagacagaagaaaaagttttg

SEQ ID NO: 734849 - DNA, 3305 bp, Homo sapiens
  misc_feature (2644)..(2644): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaanaaaaaaaaaaaaaaaaaaaaaaaaaaaacaacaagcagccacaagaaaacccaaccaacgagacaaaacaaaaacagcaacaaaaaaaaaagaacagagccgcggcgccggctgcacacatacacatcgcagggcggcgccccagcaccacagcaccccccacgcctatacaggagcggcggcccaccaacccggcccagctcctactaacacggacgcccgggccggccacaccccaccggcacggccgaacaccaaccacccagcaggcaatgtggcggcacccccacccgtggcgcgagtacagatcaggccagcacgaacccacccaatcagcagtaatggcgctacggagtactaaaatataagaggagcgctgcaagaaccacccacaccatctcgtcgggcagccagaacgccccgcgacgaccgcagactacatccatccacgggcggacggccaacagagtccgaggctggcgacgacgtcggacggcccgcggcaccgaggcgtcgacgaaacgacgccggaagacacactgcgagcaggcgaccagactgcagccccacgcccatcatggacacaagcgactcggacgacgcacgccatagatcaggtcccagaccaccttaacccagacggacagcgcggagacaagca

SEQ ID NO: 734850 - DNA, 3206 bp, Homo sapiens
  misc_feature (2644)..(2644): n is a, c, g, or t
  misc_feature (3206)..(3206): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaanaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 734851 - DNA, 2789 bp, Homo sapiens
  misc_feature (2645)..(2645): n is a, c, g, or t
  misc_feature (2660)..(2661): n is a, c, g, or t
  misc_feature (2669)..(2669): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaaanaaagaaaaacaaaannaaaaaaanaaaaagactattccaaaagaaagaactaggagtgggcccgtaccccaaaataaaaaacctcggggggggccccgtgcccaatttcgcccttatggagagcctttaacattcaaatgggcc

SEQ ID NO: 734852 - DNA, 2900 bp, Homo sapiens
  misc_feature (2645)..(2645): n is a, c, g, or t
  misc_feature (2660)..(2661): n is a, c, g, or t
  misc_feature (2669)..(2669): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaaanaaagaaaaacaaaannaaaaaaanaaaaaaaaaaagcaaaaaaaaaaccgcgcagaggatttcatgtgggggggggggaagaaaaagagaggatgaaaagaagagggagccgaggtggtgaccaatatggtggtgtgccgagaccacatttttttgttaaaaagagggggagaaaaagagggggggcctcccattaataggggagggagggattatatttgggagagagccgaggggagagccgggttattaagg

SEQ ID NO: 734853 - DNA, 2599 bp, Homo sapiens
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatggggccattcaacgcctccgggccattgaacgcctccg

SEQ ID NO: 734854 - DNA, 2587 bp, Homo sapiens
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgattgggccaggggggggtaccgagg

SEQ ID NO: 734855 - DNA, 2460 bp, Homo sapiens
  misc_feature (2428)..(2428): n is a, c, g, or t
  misc_feature (2441)..(2441): n is a, c, g, or t
  misc_feature (2445)..(2445): n is a, c, g, or t
  misc_feature (2460)..(2460): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctaccccnggggcctccgaanaagnaaaagctcgaattgn

SEQ ID NO: 734856 - DNA, 2884 bp, Homo sapiens
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtcgcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaacaaacacaaaacaacacacacaacaaacaacaaaaaacaacaaccacacacacaaacacacacaaccaagagagggggcgcgcgccgccaaaaagagagagaccacccccaggggggcgcacgcaaacacagcagcgaacccccacgctgtggagcacaaaagggg

SEQ ID NO: 734857 - DNA, 2774 bp, Homo sapiens
  misc_feature (2581)..(2583): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaacaaaaaacaaaacaaacaaaaaaaaacaaannncgcgggctaaaatcccgggggcagtacgtccccttttggcacgggcctagagggataaaaagacccgggacaacgcggaggaagcggcggcttggcgccttctgggtgacgaaacccagagttcccgcaacgttgtgaccttggtgtatacatcttagcgcggacatactctcacgcactcacctcacatc

SEQ ID NO: 734858 - DNA, 2694 bp, Homo sapiens
  misc_feature (2567)..(2567): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacatacanaaaaaaaagggggggttttttggggggggggaaaaagggttttgaagggaaggggtaagggtttctggacccgttttgttaaagggggaaatgggggccccaagggggggaaaaaggaagggggacg

SEQ ID NO: 734859 - DNA, 2960 bp, Homo sapiens
  misc_feature (2574)..(2574): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaatttgggggtctggtggtgtgcgggtggaatggcctgtgagtccctctagctgtccttaacctgcagcccaaattatccacttgtggaggggatcttgggggcatcctggagccccaggagtcccggggaagaaaggctgggagctggagaagaggaggagaagcaatgcccagcctcatagctgcttgcttacacactcacaccccagctgcacctggctcccaaacactcctcgcctacccacgtttcctcacacacactcacacccgaatcatacagaggtgtgctttcaaatgcacacacacatacattcactcagcaaataggtgcagactccccaaaacaaacccagtctctgatcccacatgaagggatcctctaga

SEQ ID NO: 734860 - DNA, 3249 bp, Homo sapiens
  misc_feature (2574)..(2574): n is a, c, g, or t
  misc_feature (2588)..(2588): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaaaaaaaaaaaanaaaaaaaaaaaaaaaaaaaaaaaaaaaacaacaagcagccacaagaaaacccaaccaacgagacaaaacaaaaacagcaacaaaaaaaaaagaacagagccgcggcgccggctgcacacatacacatcgcagggcggcgccccagcaccacagcaccccccacgcctatacaggagcggcggcccaccaacccggcccagctcctactaacacggacgcccgggccggccacaccccaccggcacggccgaacaccaaccacccagcaggcaatgtggcggcacccccacccgtggcgcgagtacagatcaggccagcacgaacccacccaatcagcagtaatggcgctacggagtactaaaatataagaggagcgctgcaagaaccacccacaccatctcgtcgggcagccagaacgccccgcgacgaccgcagactacatccatccacgggcggacggccaacagagtccgaggctggcgacgacgtcggacggcccgcggcaccgaggcgtcgacgaaacgacgccggaagacacactgcgagcaggcgaccagactgcagccccacgcccatcatggacacaagcgactcggacgacgcacgccatagatcaggtcccagaccaccttaacccagacggacagcgcggagacaagca

SEQ ID NO: 734861 - DNA, 3150 bp, Homo sapiens
  misc_feature (2574)..(2574): n is a, c, g, or t
  misc_feature (2588)..(2588): n is a, c, g, or t
  misc_feature (3150)..(3150): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaaaaaaaaaaaanaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 734862 - DNA, 2583 bp, Homo sapiens
  misc_feature (2551)..(2551): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaanggaaaaggcagcagacagaagaaaaagttttg

SEQ ID NO: 734863 - DNA, 3222 bp, Homo sapiens
  misc_feature (2561)..(2561): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaanaaaaaaaaaaaaaaaaaaaaaaaaaaaacaacaagcagccacaagaaaacccaaccaacgagacaaaacaaaaacagcaacaaaaaaaaaagaacagagccgcggcgccggctgcacacatacacatcgcagggcggcgccccagcaccacagcaccccccacgcctatacaggagcggcggcccaccaacccggcccagctcctactaacacggacgcccgggccggccacaccccaccggcacggccgaacaccaaccacccagcaggcaatgtggcggcacccccacccgtggcgcgagtacagatcaggccagcacgaacccacccaatcagcagtaatggcgctacggagtactaaaatataagaggagcgctgcaagaaccacccacaccatctcgtcgggcagccagaacgccccgcgacgaccgcagactacatccatccacgggcggacggccaacagagtccgaggctggcgacgacgtcggacggcccgcggcaccgaggcgtcgacgaaacgacgccggaagacacactgcgagcaggcgaccagactgcagccccacgcccatcatggacacaagcgactcggacgacgcacgccatagatcaggtcccagaccaccttaacccagacggacagcgcggagacaagca

SEQ ID NO: 734864 - DNA, 3123 bp, Homo sapiens
  misc_feature (2561)..(2561): n is a, c, g, or t
  misc_feature (3123)..(3123): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaanaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 734865 - DNA, 2706 bp, Homo sapiens
  misc_feature (2562)..(2562): n is a, c, g, or t
  misc_feature (2577)..(2578): n is a, c, g, or t
  misc_feature (2586)..(2586): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaaanaaagaaaaacaaaannaaaaaaanaaaaagactattccaaaagaaagaactaggagtgggcccgtaccccaaaataaaaaacctcggggggggccccgtgcccaatttcgcccttatggagagcctttaacattcaaatgggcc

SEQ ID NO: 734866 - DNA, 2817 bp, Homo sapiens
  misc_feature (2562)..(2562): n is a, c, g, or t
  misc_feature (2577)..(2578): n is a, c, g, or t
  misc_feature (2586)..(2586): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaaanaaagaaaaacaaaannaaaaaaanaaaaaaaaaaagcaaaaaaaaaaccgcgcagaggatttcatgtgggggggggggaagaaaaagagaggatgaaaagaagagggagccgaggtggtgaccaatatggtggtgtgccgagaccacatttttttgttaaaaagagggggagaaaaagagggggggcctcccattaataggggagggagggattatatttgggagagagccgaggggagagccgggttattaagg

SEQ ID NO: 734867 - DNA, 2516 bp, Homo sapiens
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatggggccattcaacgcctccgggccattgaacgcctccg

SEQ ID NO: 734868 - DNA, 2504 bp, Homo sapiens
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgattgggccaggggggggtaccgagg

SEQ ID NO: 734869 - DNA, 2377 bp, Homo sapiens
  misc_feature (2345)..(2345): n is a, c, g, or t
  misc_feature (2358)..(2358): n is a, c, g, or t
  misc_feature (2362)..(2362): n is a, c, g, or t
  misc_feature (2377)..(2377): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctaccccnggggcctccgaanaagnaaaagctcgaattgn

SEQ ID NO: 734870 - DNA, 2801 bp, Homo sapiens
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtcgcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaacaaacacaaaacaacacacacaacaaacaacaaaaaacaacaaccacacacacaaacacacacaaccaagagagggggcgcgcgccgccaaaaagagagagaccacccccaggggggcgcacgcaaacacagcagcgaacccccacgctgtggagcacaaaagggg

SEQ ID NO: 734871 - DNA, 2746 bp, Homo sapiens
  misc_feature (2553)..(2555): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaacaaaaaacaaaacaaacaaaaaaaaacaaannncgcgggctaaaatcccgggggcagtacgtccccttttggcacgggcctagagggataaaaagacccgggacaacgcggaggaagcggcggcttggcgccttctgggtgacgaaacccagagttcccgcaacgttgtgaccttggtgtatacatcttagcgcggacatactctcacgcactcacctcacatc

SEQ ID NO: 734872 - DNA, 2666 bp, Homo sapiens
  misc_feature (2539)..(2539): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacatacanaaaaaaaagggggggttttttggggggggggaaaaagggttttgaagggaaggggtaagggtttctggacccgttttgttaaagggggaaatgggggccccaagggggggaaaaaggaagggggacg

SEQ ID NO: 734873 - DNA, 2932 bp, Homo sapiens
  misc_feature (2546)..(2546): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaatttgggggtctggtggtgtgcgggtggaatggcctgtgagtccctctagctgtccttaacctgcagcccaaattatccacttgtggaggggatcttgggggcatcctggagccccaggagtcccggggaagaaaggctgggagctggagaagaggaggagaagcaatgcccagcctcatagctgcttgcttacacactcacaccccagctgcacctggctcccaaacactcctcgcctacccacgtttcctcacacacactcacacccgaatcatacagaggtgtgctttcaaatgcacacacacatacattcactcagcaaataggtgcagactccccaaaacaaacccagtctctgatcccacatgaagggatcctctaga

SEQ ID NO: 734874 - DNA, 3221 bp, Homo sapiens
  misc_feature (2546)..(2546): n is a, c, g, or t
  misc_feature (2560)..(2560): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaaaaaaaaaaaanaaaaaaaaaaaaaaaaaaaaaaaaaaaacaacaagcagccacaagaaaacccaaccaacgagacaaaacaaaaacagcaacaaaaaaaaaagaacagagccgcggcgccggctgcacacatacacatcgcagggcggcgccccagcaccacagcaccccccacgcctatacaggagcggcggcccaccaacccggcccagctcctactaacacggacgcccgggccggccacaccccaccggcacggccgaacaccaaccacccagcaggcaatgtggcggcacccccacccgtggcgcgagtacagatcaggccagcacgaacccacccaatcagcagtaatggcgctacggagtactaaaatataagaggagcgctgcaagaaccacccacaccatctcgtcgggcagccagaacgccccgcgacgaccgcagactacatccatccacgggcggacggccaacagagtccgaggctggcgacgacgtcggacggcccgcggcaccgaggcgtcgacgaaacgacgccggaagacacactgcgagcaggcgaccagactgcagccccacgcccatcatggacacaagcgactcggacgacgcacgccatagatcaggtcccagaccaccttaacccagacggacagcgcggagacaagca

SEQ ID NO: 734875 - DNA, 3122 bp, Homo sapiens
  misc_feature (2546)..(2546): n is a, c, g, or t
  misc_feature (2560)..(2560): n is a, c, g, or t
  misc_feature (3122)..(3122): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaaaaaaaaaaaanaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 734876 - DNA, 2555 bp, Homo sapiens
  misc_feature (2523)..(2523): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaanggaaaaggcagcagacagaagaaaaagttttg

SEQ ID NO: 734877 - DNA, 3194 bp, Homo sapiens
  misc_feature (2533)..(2533): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaanaaaaaaaaaaaaaaaaaaaaaaaaaaaacaacaagcagccacaagaaaacccaaccaacgagacaaaacaaaaacagcaacaaaaaaaaaagaacagagccgcggcgccggctgcacacatacacatcgcagggcggcgccccagcaccacagcaccccccacgcctatacaggagcggcggcccaccaacccggcccagctcctactaacacggacgcccgggccggccacaccccaccggcacggccgaacaccaaccacccagcaggcaatgtggcggcacccccacccgtggcgcgagtacagatcaggccagcacgaacccacccaatcagcagtaatggcgctacggagtactaaaatataagaggagcgctgcaagaaccacccacaccatctcgtcgggcagccagaacgccccgcgacgaccgcagactacatccatccacgggcggacggccaacagagtccgaggctggcgacgacgtcggacggcccgcggcaccgaggcgtcgacgaaacgacgccggaagacacactgcgagcaggcgaccagactgcagccccacgcccatcatggacacaagcgactcggacgacgcacgccatagatcaggtcccagaccaccttaacccagacggacagcgcggagacaagca

SEQ ID NO: 734878 - DNA, 3095 bp, Homo sapiens
  misc_feature (2533)..(2533): n is a, c, g, or t
  misc_feature (3095)..(3095): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaanaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 734879 - DNA, 2678 bp, Homo sapiens
  misc_feature (2534)..(2534): n is a, c, g, or t
  misc_feature (2549)..(2550): n is a, c, g, or t
  misc_feature (2558)..(2558): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaaanaaagaaaaacaaaannaaaaaaanaaaaagactattccaaaagaaagaactaggagtgggcccgtaccccaaaataaaaaacctcggggggggccccgtgcccaatttcgcccttatggagagcctttaacattcaaatgggcc

SEQ ID NO: 734880 - DNA, 2789 bp, Homo sapiens
  misc_feature (2534)..(2534): n is a, c, g, or t
  misc_feature (2549)..(2550): n is a, c, g, or t
  misc_feature (2558)..(2558): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaaanaaagaaaaacaaaannaaaaaaanaaaaaaaaaaagcaaaaaaaaaaccgcgcagaggatttcatgtgggggggggggaagaaaaagagaggatgaaaagaagagggagccgaggtggtgaccaatatggtggtgtgccgagaccacatttttttgttaaaaagagggggagaaaaagagggggggcctcccattaataggggagggagggattatatttgggagagagccgaggggagagccgggttattaagg

SEQ ID NO: 734881 - DNA, 2488 bp, Homo sapiens
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatggggccattcaacgcctccgggccattgaacgcctccg

SEQ ID NO: 734882 - DNA, 2476 bp, Homo sapiens
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgattgggccaggggggggtaccgagg

SEQ ID NO: 734883 - DNA, 2349 bp, Homo sapiens
  misc_feature (2317)..(2317): n is a, c, g, or t
  misc_feature (2330)..(2330): n is a, c, g, or t
  misc_feature (2334)..(2334): n is a, c, g, or t
  misc_feature (2349)..(2349): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctaccccnggggcctccgaanaagnaaaagctcgaattgn

SEQ ID NO: 734884 - DNA, 2773 bp, Homo sapiens
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacaaaagactgagatctctgagatgaaccggaacatcagccggctccaggctgagattgagggcctcaaaggccagagggcttccctggaggccgccattgcagatgccgagcagcgtggagagctggccattaaggatgccaacgccaacgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtcgcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaacaaacacaaaacaacacacacaacaaacaacaaaaaacaacaaccacacacacaaacacacacaaccaagagagggggcgcgcgccgccaaaaagagagagaccacccccaggggggcgcacgcaaacacagcagcgaacccccacgctgtggagcacaaaagggg

SEQ ID NO: 734885 - DNA, 2274 bp, Homo sapiens
  misc_feature (2081)..(2083): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgcctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaacaaaaaacaaaacaaacaaaaaaaaacaaannncgcgggctaaaatcccgggggcagtacgtccccttttggcacgggcctagagggataaaaagacccgggacaacgcggaggaagcggcggcttggcgccttctgggtgacgaaacccagagttcccgcaacgttgtgaccttggtgtatacatcttagcgcggacatactctcacgcactcacctcacatc

SEQ ID NO: 734886 - DNA, 2194 bp, Homo sapiens
  misc_feature (2067)..(2067): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgcctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacatacanaaaaaaaagggggggttttttggggggggggaaaaagggttttgaagggaaggggtaagggtttctggacccgttttgttaaagggggaaatgggggccccaagggggggaaaaaggaagggggacg

SEQ ID NO: 734887 - DNA, 2460 bp, Homo sapiens
  misc_feature (2074)..(2074): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgcctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaatttgggggtctggtggtgtgcgggtggaatggcctgtgagtccctctagctgtccttaacctgcagcccaaattatccacttgtggaggggatcttgggggcatcctggagccccaggagtcccggggaagaaaggctgggagctggagaagaggaggagaagcaatgcccagcctcatagctgcttgcttacacactcacaccccagctgcacctggctcccaaacactcctcgcctacccacgtttcctcacacacactcacacccgaatcatacagaggtgtgctttcaaatgcacacacacatacattcactcagcaaataggtgcagactccccaaaacaaacccagtctctgatcccacatgaagggatcctctaga

SEQ ID NO: 734888 - DNA, 2749 bp, Homo sapiens
  misc_feature (2074)..(2074): n is a, c, g, or t
  misc_feature (2088)..(2088): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgcctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaaaaaaaaaaaanaaaaaaaaaaaaaaaaaaaaaaaaaaaacaacaagcagccacaagaaaacccaaccaacgagacaaaacaaaaacagcaacaaaaaaaaaagaacagagccgcggcgccggctgcacacatacacatcgcagggcggcgccccagcaccacagcaccccccacgcctatacaggagcggcggcccaccaacccggcccagctcctactaacacggacgcccgggccggccacaccccaccggcacggccgaacaccaaccacccagcaggcaatgtggcggcacccccacccgtggcgcgagtacagatcaggccagcacgaacccacccaatcagcagtaatggcgctacggagtactaaaatataagaggagcgctgcaagaaccacccacaccatctcgtcgggcagccagaacgccccgcgacgaccgcagactacatccatccacgggcggacggccaacagagtccgaggctggcgacgacgtcggacggcccgcggcaccgaggcgtcgacgaaacgacgccggaagacacactgcgagcaggcgaccagactgcagccccacgcccatcatggacacaagcgactcggacgacgcacgccatagatcaggtcccagaccaccttaacccagacggacagcgcggagacaagca

SEQ ID NO: 734889 - DNA, 2650 bp, Homo sapiens
  misc_feature (2074)..(2074): n is a, c, g, or t
  misc_feature (2088)..(2088): n is a, c, g, or t
  misc_feature (2650)..(2650): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgcctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaacaaaaaaaaaaaaanaaaaaaaaaaaaanaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 734890 - DNA, 2083 bp, Homo sapiens
  misc_feature (2051)..(2051): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgcctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaanggaaaaggcagcagacagaagaaaaagttttg

SEQ ID NO: 734891 - DNA, 2722 bp, Homo sapiens
  misc_feature (2061)..(2061): n is a, c, g, or t
ggcattgtcaatctgcagaacgatgcgggcattgtccacagtatttgcgaagatctggagggattgtagagagaggttgttccatgaatagaaagccagggatgggtggggtgagtgtgtaaaaagtgttatgtatcctagtgaaaacttcctggtcccaggaatagccagaggctctccctggacacctatcccttttcatctagccccaccccattccctcctttcctggattcccagatcccagcactctgcccctcttgggaagcctcagcaggctggctagctggctggcctgcctgcccagaagtgagtcgctactaacaagtcctcttcctggccctctcctggcattttttccctagtgcacctggtcactctgggccccctacaccctggattggctcctcccaaaggaaggcctcttgtttactcctagatgactcagccttagccacatccgcttaaccctccaatagtccccattccgccagagccggtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgcctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaanaaaaaaaaaaaaaaaaaaaaaaaaaaaacaacaagcagccacaagaaaacccaaccaacgagacaaaacaaaaacagcaacaaaaaaaaaagaacagagccgcggcgccggctgcacacatacacatcgcagggcggcgccccagcaccacagcaccccccacgcctatacaggagcggcggcccaccaacccggcccagctcctactaacacggacgcccgggccggccacaccccaccggcacggccgaacaccaaccacccagcaggcaatgtggcggcacccccacccgtggcgcgagtacagatcaggccagcacgaacccacccaatcagcagtaatggcgctacggagtactaaaatataagaggagcgctgcaagaaccacccacaccatctcgtcgggcagccagaacgccccgcgacgaccgcagactacatccatccacgggcggacggccaacagagtccgaggctggcgacgacgtcggacggcccgcggcaccgaggcgtcgacgaaacgacgccggaagacacactgcgagcaggcgaccagactgcagccccacgcccatcatggacacaagcgactcggacgacgcacgccatagatcaggtcccagaccaccttaacccagacggacagcgcggagacaagca

SEQ ID NO: 734892 - DNA, 3801 bp, Homo sapiens
taaatgaaaaatgaataaatcattgcagaacagtgtatatatatctaaaatatctatggaagaaaccagcaacagccactgctcctggagaattatggtcccacaccactgatcattctttcagtagggtgaccatcatccaaatttgcttgggactgagggggttccttttggtttgaaaaccaggacagtcctaggaaaagtgagacaagttggtcacatgtccccaagatgatcttctttcacttatgaacttgctactttcccagtcagaatataaactctgaagggggagacttcctgttttcttcatgactatatctcttgcgcactgtggggtggaggctgtagaagaggagagaagtagagaaacagatcacattgtgtcttgaagtgtttcagcaaatatgggcaacacccttcttttactagcttggaaccctacctctgagtgcatttccctttttattatttatttcctgtcagttataagagaggcctacccctttgtgagcagtctaggactttgtacacctgttaagtagggagaaggcaggggaggtggctggtttaaggggaacttgagggaagtagggaagactcctcttgggacctttggagtaggtgacacatgagcccagccccagctcacctgccaatccagctgaggagctcacctgccaatccagctgaggctgggcagaggtgggtgagaagagggaaaattgcagggacctccagttgggccaggccagaagctgctgtagctttaaccagacagctcagacctgtctggaggctgccagtgacaggttaggtttagggcagagaagaagcaagaccatggtggggaagatgtggcctgtgttgtggacactctgtgcagtcagggtgaccgtcgatgccatctctgtggaaactccgcaggacgttcttcgggcttcgcagggaaagagtgtcaccctgccctgcacctaccacacttccacctccagtcgagagggacttattcaatgggataagctcctcctcactcatacggaaagggtggtcatctggccgttttcaaacaaaaactacatccatggtgagctttataagaatcgcgtcagcatatccaacaatgctgagcagtccgatgcctccatcaccattgatcagctgaccatggctgacaacggcacctacgagtgttctgtctcgctgatgtcagacctggagggcaacaccaagtcacgtgtccgcctgttggtcctcgtgccaccctccaaaccagaatgcggcatcgagggagagaccataattgggaacaacatccagctgacctgccaatcaaaggagggctcaccaacccctcagtacagctggaagaggtacaacatcctgaatcaggagcagcccctggcccagccagcctcaggtcagcctgtctccctgaagaatatctccacagacacatcgggttactacatctgtacctccagcaatgaggaggggacgcagttctgcaacatcacggtggccgtcagatctccctccatgaacgtggccctgtatgtgggcatcgcggtgggcgtggttgcagccctcattatcattggcatcatcatctactgctgctgctgccgagggaaggacgacaacactgaagacaaggaggatgcaaggccgaaccgggaagcctatgaggagccaccagagcagctaagagaactttccagagagagggaggaggaggatgactacaggcaagaagagcagaggagcactgggcgtgaatccccggaccacctcgaccagtgacaggccagcagcagagggcggcggaggaagggttaggggttcattctcccgcttcctggcctcccttctcctttctaagccctgttctcctgtccctccatcccagacattgatggggacatttcttccccagtgtcagctgtggggaacatggctggcctggtaagggggtccctgtgctgatcctgctgacctcactgtcctgtgaagtaacccctcctggctgtgacacctggtgcgggcctggccctcactcaagaccaggctgcagcctccacttccctcgtagttggcaggagctcctggaagcacagcgctgagcatggggcgctcccactcagaactctccagggaggcgatgccagccttggggggtgggggctgtcctgctcacctgtgtgcccagcacctggaggggcaccaggtggagggtttgcactccacacatctttcttgaatgaatgaaagaataagtgagtatgcttgggccctgcattggcctggcctccagctcccactccctttccaacctcacttcccgtagctgccagtatgttccaaaccctcctgggaaggccacctcccactcctgctgcacaggccctggggagcttttgcccacacactttccatctctgcctgtcaatatcgtacctgtccctccaggcccatctcaaatcacaaggatttctctaaccctatcctaattgtccacatacgtggaaacaatcctgttactctgtcccacgtccaatcatgggccacaaggcacagtcttctgagcgagtgctctcactgtattagagcgccagctccttggggcagggcctgggcctcatggcttttgctttccctgaagccctagtagctggcgcccatcctagtgggcacttaagcttaattggggaaactgctttgattggttgtgccttcccttctctggtctccttgagatgatcgtagacacagggatgattcccacccaaacccacgtattcattcagtgagttaaacacgaattgatttaaagtgaacacacacaagggagcttgcttgcagatggtctgagttcttgtgtcctggtaattcctctccaggccagaataattggcatgtctcctcaacccacatggggttcctggttgttcctgcatcccgatacctcagccctggccctgcccagcccatttgggctctggttttctggtggggctgtcctgctgccctcccacagcctccttctgtttgtcgagcatttcttctactcttgagagctcaggcagcgttagggctgcttaggtctcatggaccagtggctggtctcacccaactgcagtttactattgctatcttttctggatgatcagaaaaataattccataaatctattgtctacttgcgattttttaaaaaatgtatatttttatatatattgttaaatcctttgcttcattccaaatgctttcagtaataataaaattgtgggtggaaattcttaaaacttttttaatgtggattttgtttgcagtaagataaagcttgggtctcatggatcatctctactcaccatagcactcttctgcttcctaggggaggtgagacaaggtaacagatttgagaatcctggggtccctctgcttgtggccgcagtagggtcaggcagtgcctctagtggttgctgggaataggacagattcctgcctgctggtggaggtatattccaggagtctgcagtgtcaggacaccaggaggcctgggtgtcggtccacgtgcttgaaggaagatggtggagatgctctagccagttctgcttcctatgatgccccttctgagaaaggggcggggcagtcctcttgttctgtcacagagaactgtgacgcttcctcctccaaggcaacttcgctccgctgtgggctcttggctttgacatggactctcctgcgagatattcaaggtctgttcttcagtgtcctttcctgtgctccctcctgtccgagc

SEQ ID NO: 734893 - DNA, 3439 bp, Homo sapiens
taaatgaaaaatgaataaatcattgcagaacagtgtatatatatctaaaatatctatggaagaaaccagcaacagccactgctcctggagaattatggtcccacaccactgatcattctttcagtagggtgaccatcatccaaatttgcttgggactgagggggttccttttggtttgaaaaccaggacagtcctaggaaaagtgagacaagttggtcacatgtccccaagatgatcttctttcacttatgaacttgctactttcccagtcagaatataaactctgaagggggagacttcctgttttcttcatgactatatctcttgcgcactgtggggtggaggctgtagaagaggagagaagtagagaaacagatcacattgtgtcttgaagtgtttcagcaaatatgggcaacacccttcttttactagcttggaaccctacctctgagtgcatttccctttttattatttatttcctgtcagttataagagaggcctacccctttgtgagcagtctaggactttgtacacctgttaagtagggagaaggcaggggaggtggctggtttaaggggaacttgagggaagtagggaagactcctcttgggacctttggagtaggtgacacatgagcccagccccagctcacctgccaatccagctgaggagctcacctgccaatccagctgaggctgggcagaggtgggtgagaagagggaaaattgcagggacctccagttgggccaggccagaagctgctgtagctttaaccagacagctcagacctgtctggaggctgccagtgacaggttaggtttagggcagagaagaagcaagaccatggtggggaagatgtggcctgtgttgtggacactctgtgcagtcagggtgaccgtcgatgccatctctgtggaaactccgcaggacgttcttcgggcttcgcagggaaagagtgtcaccctgccctgcacctaccacacttccacctccagtcgagagggacttattcaatgggataagctcctcctcactcatacggaaagggtggtcatctggccgttttcaaacaaaaactacatccatggtgagctttataagaatcgcgtcagcatatccaacaatgctgagcagtccgatgcctccatcaccattgatcagctgaccatggctgacaacggcacctacgagtgttctgtctcgctgatgtcagacctggagggcaacaccaagtcacgtgtccgcctgttggtcctcgtgccaccctccaaaccagaatgcggcatcgagggagagaccataattgggaacaacatccagctgacctgccaatcaaaggagggctcaccaacccctcagtacagctggaagaggtacaacatcctgaatcaggagcagcccctggcccagccagcctcaggtcagcctgtctccctgaagaatatctccacagacacatcgggttactacatctgtacctccagcaatgaggaggggacgcagttctgcaacatcacggtggccgtcagatctccctccatgaacgtggccctgtatgtgggcatcgcggtgggcgtggttgcagccctcattatcattggcatcatcatctactgctgctgctgccgagggaaggacgacaacactgaagacaaggaggatgcaaggccgaaccgggaagcctatgaggagccaccagagcagctaagagaactttccagagagagggaggaggaggatgactacaggcaagaagagcagaggagcactgggcgtgaatccccggaccacctcgaccagtgacaggccagcagcagagggcggcggaggaagggttaggggttcattctcccgcttcctggcctcccttctcctttctaagccctgttctcctgtccctccatcccagacattgatggggacatttcttccccagtgtcagctgtggggaacatggctggcctggtaagggggtccctgtgctgatcctgctgacctcactgtcctgtgaagtaacccctcctggctgtgacacctggtgcgggcctggccctcactcaagaccaggctgcagcctccacttccctcgtagttggcaggagctcctggaagcacagcgctgagcatggggcgctcccactcagaactctccagggaggcgatgccagccttggggggtgggggctgtcctgctcacctgtgtgcccagcacctggaggggcaccaggtggagggtttgcactccacacatctttcttgaatgaatgaaagaataagtgagtatgcttgggccctgcattggcctggcctccagctcccactccctttccaacctcacttcccgtagctgccagtatgttccaaaccctcctgggaaggccacctcccactcctgctgcacaggccctggggagcttttgcccacacactttccatctctgcctgtcaatatcgtacctgtccctccaggcccatctcaaatcacaaggatttctctaaccctatcctaattgtccacatacgtggaaacaatcctgttactctgtcccacgtccaatcatgggccacaaggcacagtcttctgagcgagtgctctcactgtattagagcgccagctccttggggcagggcctgggcctcatggcttttgctttccctgaagccctagtagctggcgcccatcctagtgggcacttaagcttaattggggaaactgctttgattggttgtgccttcccttctctggtctccttgagatgatcgtagacacagggatgattcccacccaaacccacgtattcattcagtgagttaaacacgaattgatttaaagtgaacacacacaagggagcttgcttgcagatggtctgagttcttgtgtcctggtaattcctctccaggccagaataattggcatgtctcctcaacccacatggggttcctggttgttcctgcatcccgatacctcagccctggccctgcccagcccatttgggctctggttttctggtggggctgtcctgctgccctcccacagcctccttctgtttgtcgagcatttcttctactcttgagagctcaggcagcgttagggctgcttaggtctcatggaccagtggctggtctcacccaactgcagtttactattgctatcttttctggatgatcagtcagattttcttatcctacactcgcttgtcctgttcgcgacaagcaaaatcagtaattattttaaaatgaacatatgtatttttattaacttttagttaaatacagattatacaacgaggtcagcataagcctaaatcaatatagagggctaactcaggcattgtcttgttaatttgtagactggattaaaaacaacctgtcctgttttgtcagttcccagttacttcgtttagaataaattagaccaaaagaagaaactgctgtcctg

SEQ ID NO: 734894 - DNA, 250 bp, Homo sapiens
gcccaacaccttaaaccccccgagcacacaaagcagtgagaagtagttatcttcctggttctttctagttgcctaataacatagttggcttgctctggtctcaagtcaatttggaaacagagagagaatcaagagaatcaaatcaggggacgaagcaaaacaaaagtgaatagcaaacaataagcacatgaaaaatgtgcaacattagccatgggggaaaattcaaatcaaaaccgcaattagataccac

SEQ ID NO: 734895 - DNA, 250 bp, Homo sapiens
ttgtgggtgtggggtcggggctcacctcctcccacatccctgcccagaggtgggcagagtgggggcagtgccttgctccccctgctcgctctctgctgacctccggctccctgtgctgccccaggaccatgaatggcacctacaacacctgtggctccagcgacctcacctggcccccagcgatcaagctgggcttctacgcctacttgggcgtcctgctggtgctaggcctgctgctcaacagcctggc

SEQ ID NO: 734896 - DNA, 250 bp, Homo sapiens
ctcagagatgaagtaggctcagttatctgcatgaaaggtagctgtctctggaaaagctaaagatgtgatttctgcatttcctcacttaatatgcaccaagaagtggacattgaccttcagagagtagagctttcatttattgggtaatgaaccaatttgctgtcaaattgtttcatcagatgctattagtcacctgggatacagtggataaggattttaattttattattttcaagggacaagacttttg

SEQ ID NO: 734897 - DNA, 250 bp, Homo sapiens
acctcccttcaaaattagaaccaagatgagaatgaagttgaaggatgaagatgttttatataatatctttacttacaaaaattaaaagaccaaagatgtgctgtaattctgaacttcactggatctacaaacatcaatagtggtcggcagggcgtgggggctcatgccagtgatcccagcactttgggaggccaaggtgggtggatcagttggggtcaggatttcgagaccagtctggccaacatggtga

SEQ ID NO: 734898 - DNA, 250 bp, Homo sapiens
cgtgggccgctggggctctccctttctaagggaggcacctgaaagtgtgaggatcaagagcagtaggaggtgtcagtaataaacctaataagcactgtccagggcatgacacgtcacctcagccccagagcctgctgaatccccaactcctgcttttctgtacctccccttcctcccactggcttctctgcttctgagctgcctgcctctggactttctcttttagtctgtgactttcccctaccctcac

SEQ ID NO: 734899 - DNA, 250 bp, Homo sapiens
cgtgtcagctgtggctgcaactcctttggaaaatgcctgctcctgtttagaaggctgtgcctgtgttcattaaagagtcactggggtcctgttgtgttggacacagtcaaggcacaaaatcaaatcctatccagtatctgacggcctgggtggggcggagaacggacttcacacactagtttgttgaggtctcttggaaagcacagcaaagagcagcagtaggtgctaaaccccttgtttcttttcttag

SEQ ID NO: 734900 - DNA, 250 bp, Homo sapiens
ttatttcaagccaagataattttagaacattacttcttacaccagcagttgcctgactgtactgatctcacaaaataagcaggaaaggatgttgagaaatgaagtgaacgcctgtgaccaaatcatcaaagaactagaagagggaaactgtgagtagagtattcctatagaaccttctttccaatatcatggttgtgactggggagggtgcctgagagaaatatgatggaaggaccgggtaaacacacct

SEQ ID NO: 734901 - DNA, 250 bp, Homo sapiens
gttatccccaacacccaccccaaatatttcccaggtctcgctgagctctgccagtctgttttcactgccctttgaaactcataactaagacaccaaagcttccagatgcctccagatgcttccagatctgaccaagactgctgaggcagacaaagcatggaccacagcgatggggcatgagagagtggggctgccttccctctgccggggcagcagaggctgaggctgtgactgtgttgggcgataacat

SEQ ID NO: 734902 - DNA, 250 bp, Homo sapiens
atatggaacttaaggagcctttaaagcttcacattttgataacttcgtctttggtacgttttctcccatatacatcatgccttacttttcataccatgaatttctacaatatagaacttaactaattctgtccaatattataaaaacatcccacagtttccacctaagaaagagacaaagagtgagcaaaaagtaaaagaaataagaaaaccaatacctctcagggtagattttgtatttcattgtatgg

SEQ ID NO: 734903 - DNA, 250 bp, Homo sapiens
gaaagatatgagcccacagataaagaaggcacattatatattaaacaggataaacagctctacacaagattacaaaagcctactcaaatacatcaaaaatcacactaaacagaaacagaacaaactttacagctgaaagattgaggttgtcaaaaaggatgaagaaataaacctcctagtgatttgctatttaatagaggcatgcctatgataaataatagaaaagggttagaagtaaaaggatagaaaa

SEQ ID NO: 734904 - DNA, 250 bp, Homo sapiens
ttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaa

SEQ ID NO: 734905 - DNA, 250 bp, Homo sapiens
atataaagaaaaccaggaagattaagacagtcgtgcaagaagtagtggatggcaaggtcgtgtcatctgaagtcaaagaggtggaagaaaatatctaaatagctaccagaaggagatgctgctgaggttttgaaagaaatttggctataatcttatctttgctccctgcaagaaatcagccataagaaagcactattaatactctgcagtgattagaaggggtggggtggcgggaatcctatttatcaga

SEQ ID NO: 734906 - DNA, 250 bp, Homo sapiens
ctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacatta

SEQ ID NO: 734907 - DNA, 250 bp, Homo sapiens
taaatgaggtataaggactcacacaaattaaaatacagctgcactgaggcagcgacctcaagtgtcctgaaagcttacattttcctgagacctcaatgaagcagaaatgtacttaggcttggctgccctgtctggaacatggactttcttgcatgaatcagatgtgtgttctcagtgaaataactaccttccactctggaaccttattccagcagttgttccagggagcttctacctggaaaagaaaaga

SEQ ID NO: 734908 - DNA, 250 bp, Homo sapiens
gtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagg

SEQ ID NO: 734909 - DNA, 250 bp, Homo sapiens
gtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaa

SEQ ID NO: 734910 - DNA, 250 bp, Homo sapiens
gttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgca

SEQ ID NO: 734911 - DNA, 250 bp, Homo sapiens
agctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctgg

SEQ ID NO: 734912 - DNA, 250 bp, Homo sapiens
ctgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttac

SEQ ID NO: 734913 - DNA, 250 bp, Homo sapiens
acagccaaccaagcattccctaccctcctgggtgagatctgagaatgagaaacaccatgcttcacaaggatgctctccatggaattctccccaggccctaaaatgaatgaaaaaaaatgtgatctgagccacatggggacgtttccatctttccttatggtggatttttaagcatcaagtatccaagggtttgctcccatctgtaatgaaactagctgcgctctgggatacagatggggtttcacttctc

SEQ ID NO: 734914 - DNA, 250 bp, Homo sapiens
gtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctca

SEQ ID NO: 734915 - DNA, 250 bp, Homo sapiens
aacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaatccagaacccagtgagtgccagccgcagtgacccagtcatcctgaatgtcctct

SEQ ID NO: 734916 - DNA, 250 bp, Homo sapiens
gcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctac

SEQ ID NO: 734917 - DNA, 250 bp, Homo sapiens
caacgaatccagctcacttgctaaataagaatctatgacattaaatgtagtagatgctattagcgcttgtcagagaggtggttttcttcaatcagtacaaagtactgagacaatggttagggttgttttcttaattcttttcctggtagggcaacaagaaccatttccaatctagaggaaagctccccagcattgcttgctcctgggcaaacattgctcttgagttaagtgacctaattcccctgggaga

SEQ ID NO: 734918 - DNA, 250 bp, Homo sapiens
cagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccga

SEQ ID NO: 734919 - DNA, 250 bp, Homo sapiens
caggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacaca

SEQ ID NO: 734920 - DNA, 250 bp, Homo sapiens
ctgacttaggagtcagagcccggcaggggctgaggaggaggagcagggggtgctgcgtggaaggtgctgcaggtccttgcacgctgtgtcgcgcctctcctcctcggaaacagaaccctcccacagcacatcctacccggaagaccagcctcagagggtccttctggaaccagctgtctgtggagagaatggggtgctttcgtcagggactgctgacggctggtcctgaggaaggacaaactgcccagac

SEQ ID NO: 734921 - DNA, 250 bp, Homo sapiens
aagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaat

SEQ ID NO: 734922 - DNA, 250 bp, Homo sapiens
tttccaaccctgggaaaccatccagtctgagggaggaggccaaactcccagtgctgggggtccctgtgcagccctcaaacccttcaccttggtgcacccagccacacctggtggacacaaagctctcacatcgataggatcccatgaggatggtccccttcacctgggagaaaagtgacccagtttaggagctggaggggggtctttgtcccccacccccaaactgccctgaaataaacctggagtgagc

SEQ ID NO: 734923 - DNA, 250 bp, Homo sapiens
tcctcaacccacatggggttcctggttgttcctgcatcccgatacctcagccctggccctgcccagcccatttgggctctggttttctggtggggctgtcctgctgccctcccacagcctccttctgtttgtcgagcatttcttctactcttgagagctcaggcagcgttagggctgcttaggtctcatggaccagtggctggtctcacccaactgcagtttactattgctatcttttctggatgatcag

SEQ ID NO: 734924 - DNA, 250 bp, Homo sapiens
cacattctaacacattagaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 734925 - DNA, 250 bp, Homo sapiens
caaggagtatgtgtgacctgggatctccttgccccagcctgacaggctatgggagtgtctagatgcctgaaagggcctggggctgagctcagcctgtgggcagggtgccggacaaaggcctcctggtcactctgtccctgcactccatgtatagtcctcttgggttgggggtgggggggtgccgttggtgggagagacaaaaagagggagagtgtgctttttgtacagtaataaaaaataagtattggga

SEQ ID NO: 734926 - DNA, 250 bp, Homo sapiens
ctcaggggttgcaggcggggacatggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagc

SEQ ID NO: 734927 - DNA, 250 bp, Homo sapiens
tccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggac

SEQ ID NO: 734928 - DNA, 250 bp, Homo sapiens
ttgtgcaggtaatttgacagagtgttggatgtgtcatgtcatcatgtcaaacccaaatatttgacctaagggatcctttattctgcccagtggctaactttaacaacatccctaatacaactgtttattcaaatgcacggtggtccctgttagagttagacctctagactcacctgttctcacgccctgttttaatttaacccagctatgggatgccagataacagaattgctgcctactagctgaacag

SEQ ID NO: 734929 - DNA, 250 bp, Homo sapiens
ccggtgggctagaaagtacaagaaaaggcagcacgtggttttatgaaggtatcttaggtggagctactccccacctcccaccaacatatacattttgttgcaggaaatgtttaattccgcatgatgtttccctctccttccaacaaaagaaggtcaaactgtgggtcgtagagccttgacaatgttgtcctcctgttcatctgtgcaccacttgacagactgtagcttctcttgctctcgaccggccctg

SEQ ID NO: 734930 - DNA, 250 bp, Homo sapiens
gctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgag

SEQ ID NO: 734931 - DNA, 250 bp, Homo sapiens
tgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcc

SEQ ID NO: 734932 - DNA, 250 bp, Homo sapiens
atactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatg

SEQ ID NO: 734933 - DNA, 250 bp, Homo sapiens
aggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagt

SEQ ID NO: 734934 - DNA, 250 bp, Homo sapiens
gggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagc

SEQ ID NO: 734935 - DNA, 250 bp, Homo sapiens
ggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagat

SEQ ID NO: 734936 - DNA, 250 bp, Homo sapiens
gagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggac

SEQ ID NO: 734937 - DNA, 250 bp, Homo sapiens
gccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacagccaccg

SEQ ID NO: 734938 - DNA, 250 bp, Homo sapiens
gatctttctgcaccctggggaatcagtgatccaggtttctgggaagtacaagtggtacctgaagaagctggtatttgtgacagacaagggccgctatctgtcttttgggaaagacagtggcacaagtttcaatgccgtccccttgcaccccaacaccgtgctccgcttcatcagtggccggtctggttctctcatcgatgccattggcctgcactgggatgtttaccccactagctgcagcagatgctga

SEQ ID NO: 734939 - DNA, 250 bp, Homo sapiens
taccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagt

SEQ ID NO: 734940 - DNA, 250 bp, Homo sapiens
gtttcttctacctctgttatctaagcagagggaagtaaacttctcaccgccccccacccctcactgcccccgattacactagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaa

SEQ ID NO: 734941 - DNA, 250 bp, Homo sapiens
gactttggacatacgaggaccctcagaccggaggaacacctgcccaaccccaacacgtgcttatgtaaccacgtggaaagcggcccctgctgcccctccacacacacatacacactcactgatctacagcccctgttcggcgtcagagtccccactagacccagtggaaggggttagagaccaagtaggggccagtttccaattcaccctgtcagggagtgagccggatctgacgttccttgtgacttaa

SEQ ID NO: 734942 - DNA, 250 bp, Homo sapiens
agaggccacactacacacaccagatggcatccttgggacctgaatctatcacccaggaatctcaaactccctttggccctgaaccagggccagataaggaacagctcgggccactcttctgaaggccaatgtggaggaaagggagcagccagccgtttgggagaagatctcaaggatccagactctcattcctttcctctggcccagtgaatttggtctctcccagctctgggggactccttccttgaac

SEQ ID NO: 734943 - DNA, 250 bp, Homo sapiens
gttcttcgtgaactttgtggttgggcaggatccgggctcagacgtcgccttccacttcaatccgcggtttgacggctgggacaaggtggtcttcaacacgttgcagggcgggaagtggggcagcgaggagaggaagaggagcatgcccttcaaaaagggtgccgcctttgagctggtcttcatagtcctggctgagcactacaaggtggtggtaaatggaaatcccttctatgagtacgggcaccggctt

SEQ ID NO: 734944 - DNA, 250 bp, Homo sapiens
tatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaag

SEQ ID NO: 734945 - DNA, 250 bp, Homo sapiens
cattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatga

SEQ ID NO: 734946 - DNA, 250 bp, Homo sapiens
agcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcct

SEQ ID NO: 734947 - DNA, 250 bp, Homo sapiens
ctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattagaacaaac

SEQ ID NO: 734948 - DNA, 250 bp, Homo sapiens
aggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaattt

SEQ ID NO: 734949 - DNA, 250 bp, Homo sapiens
gcctcacctctacctgcccccatcataagggcactgagcccttcccaggctggatactaagcacaaagcccatagcactgggctctgatggctgctccactgggttacagaatcacagccctcatgatcattctcagtgagggctctggattgagagggaggccctgggaggagagaagggggcagagtcttccctaccaggtttctacacccccgccaggctgcccatcagggcccagggagcccccag

SEQ ID NO: 734950 - DNA, 250 bp, Homo sapiens
gttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacag

SEQ ID NO: 734951 - DNA, 250 bp, Homo sapiens
aaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcac

SEQ ID NO: 734952 - DNA, 250 bp, Homo sapiens
attgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctgg

SEQ ID NO: 734953 - DNA, 250 bp, Homo sapiens
ggtgcagctgggctccagggtccagcccacaagctgcatcagggtctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggcaaaaacacaacaacaacaaaacaaaaaaagagggcggcg

SEQ ID NO: 734954 - DNA, 250 bp, Homo sapiens
gggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcac

SEQ ID NO: 734955 - DNA, 250 bp, Homo sapiens
cacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgac

SEQ ID NO: 734956 - DNA, 250 bp, Homo sapiens
gaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatc

SEQ ID NO: 734957 - DNA, 250 bp, Homo sapiens
tttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaa

SEQ ID NO: 734958 - DNA, 250 bp, Homo sapiens
ttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctgga

SEQ ID NO: 734959 - DNA, 250 bp, Homo sapiens
gaacacctgtccattgaagatttcactcaggcctttgggatgactccagctgccttctctgctctgcctcgatggaagcaacaaaacctcaagaaagaaaaaggactattttgagaagagtagctgtggttgtaaagcagtaccctaccctgattgtagggtctcattttctcaccgatattagtcctacaccaattgaagtgaaattttgcagatgtgcctatgagcacaaacttctgtggcaaatgcc

SEQ ID NO: 734960 - DNA, 250 bp, Homo sapiens
agctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatg

SEQ ID NO: 734961 - DNA, 250 bp, Homo sapiens
ctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgag

SEQ ID NO: 734962 - DNA, 250 bp, Homo sapiens
gtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaact

SEQ ID NO: 734963 - DNA, 250 bp, Homo sapiens
cccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagaca

SEQ ID NO: 734964 - DNA, 250 bp, Homo sapiens
tgagaatggagaaagatagagagatctgcagactgaggtcccaattaaaccagtaccataaagatgtttcaaagagagaaggaagttgtagtgacttccaatttaagcttcatgaactgacaagcttgctggaagagaaggattccctcataaagcgtcagtcagaggaactctccaagttgcggcaagaaatatattcctctcataaccaaccctccactggtggaaggactactattaccactaaaaa

SEQ ID NO: 734965 - DNA, 250 bp, Homo sapiens
ataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccc

SEQ ID NO: 734966 - DNA, 250 bp, Homo sapiens
tccctgtgttccccaagaattcagagaacagcactggggctggaatgatctttaatgggcccaaggccaacaggcatatgcctcactactgcctggagaagggagagattcaggtcctccagcagcctccctcacccagtatgttttacagattacggggggaccgggtgagccagtgaccccctgcagcccccagcttcaggcctcagtgtctgccagtcaagcttcacaggcattgtgatggggcagc

SEQ ID NO: 734967 - DNA, 250 bp, Homo sapiens
aagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcaca

SEQ ID NO: 734968 - DNA, 250 bp, Homo sapiens
cttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatc

SEQ ID NO: 734969 - DNA, 250 bp, Homo sapiens
caagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgagg

SEQ ID NO: 734970 - DNA, 250 bp, Homo sapiens
gttaaaatctggtttcagaaccgcagagcaaaggagaggaaaatcaacaagaagaagttgcagcagcaacagcagcagcagccaccacagccgcctccgccgccaccacagcctccccagcctcagccaggtcctctgagaagtgtcccagagcccttgagtccggtgtcttccctgcaagcctcagtgtctggctctgtccctggggttctggggccaactgggggggtgctaaaccccaccgtcaccc

SEQ ID NO: 734971 - DNA, 250 bp, Homo sapiens
gacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccag

SEQ ID NO: 734972 - DNA, 250 bp, Homo sapiens
catgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttg

SEQ ID NO: 734973 - DNA, 250 bp, Homo sapiens
agaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcag

SEQ ID NO: 734974 - DNA, 250 bp, Homo sapiens
ttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaag

SEQ ID NO: 734975 - DNA, 250 bp, Homo sapiens
atgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttt

SEQ ID NO: 734976 - DNA, 250 bp, Homo sapiens
cctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctg

SEQ ID NO: 734977 - DNA, 250 bp, Homo sapiens
ccaactcagattgagccctacattgtgctgcacctggtcatacggagttgaatcagacctggttcccgcctcccccaaggctcatggtccttggaggacccgttgcagggcgaggtcaagagagttctgacctggatggcccatagacctgacgtcccagaatccatgcttctcatctgcaaaatgaaaatgtcaatacttacttcttagcactgttgagagggttacttacataaaggaattttggtga

SEQ ID NO: 734978 - DNA, 250 bp, Homo sapiens
gggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaag

SEQ ID NO: 734979 - DNA, 250 bp, Homo sapiens
ctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgta

SEQ ID NO: 734980 - DNA, 250 bp, Homo sapiens
ggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagctttt

SEQ ID NO: 734981 - DNA, 250 bp, Homo sapiens
gacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggatttt

SEQ ID NO: 734982 - DNA, 250 bp, Homo sapiens
ccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactc

SEQ ID NO: 734983 - DNA, 250 bp, Homo sapiens
ctgagcagctccaaagcactggcttggggtccgagaccttcaaagtaaagcaggcggaatggggggacaggacaatttctccccctccaggggctccaggactctccctggggggcccacctcttgccccctaacctctttcccccttttctgcccccgtggggaggagccccttgtacctgctccgtgcccaacacatgccctctctgtacatcttttgtaaatgatgagaaataaaggaagtggacgc

SEQ ID NO: 734984 - DNA, 250 bp, Homo sapiens
aggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtga

SEQ ID NO: 734985 - DNA, 250 bp, Homo sapiens
tgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtc

SEQ ID NO: 734986 - DNA, 250 bp, Homo sapiens
gggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaat

SEQ ID NO: 734987 - DNA, 250 bp, Homo sapiens
tttgacggggaccagaccaatgattggcatgactcccaggagaagccagcgatggagaaatggagagcgcaggacttctccccatgttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaag

SEQ ID NO: 734988 - DNA, 250 bp, Homo sapiens
ctgaggtgggagaatcacttgagcccaggagttcgaggctgcagtgagccaggatcatgccactgcactccagcctggtccacagagagacactgtcaccccctttcccccacaagactggcagaggctgggcagcctggggctgatgaagcagagatgttcgctggatcccaggccctggcacccctcaggaaatacaagaaaaagaatattcacatctgtttaatgtgcataaagccaaggaaaggac

SEQ ID NO: 734989 - DNA, 250 bp, Homo sapiens
tgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaag

SEQ ID NO: 734990 - DNA, 250 bp, Homo sapiens
cttttcttcccctgatttctcctctggtcatctcctctcccttctgcgtgtaagccatgggaaagggatgagggaggacagcttctggttaaacacaggtccctcttccacatcaaatgaacattggcttcctgggacagaaggccttcaaaggagggattgcaaagcaaggcaaagcgttctgtcttcattttccccatccccatgagacaagactgatggaaagggtggtggggcaacactgcttaat

SEQ ID NO: 734991 - DNA, 250 bp, Homo sapiens
tgccaggtttgttctgcacacaccaccagcccttcactcttttgtgttctatttattgagtaaatattatgtacaaggcactgtattgcatgctagagagcatacgaaatgaagatggagtgttcccactccagggtgcacactgggcagtggtaaaaggaaaatggggccgggcgcagtggttcacgcgtgtaatcctagcactttgggaggccgaggcaggtggatcatctgaggtcaggagtttgag

SEQ ID NO: 734992 - DNA, 250 bp, Homo sapiens
cagctatcttttttatttttaaaataaatacattcacatgcttttaagaaactataaaaatatataaagtaaaaagatctttctctcacactgtctccacctctcctggtctcaccgttgtgcttaggggaaaccattgtgattagtttctcctgtgtccttccagagtgtctttatgcaaatgaaaattattgtgataatatattcctattttcccccttactacacaaaagatagactaccataatcc

SEQ ID NO: 734993 - DNA, 250 bp, Homo sapiens
attcccccaaggagacagacagagggcggtggaccgaaccacagacagattcgtagggatctggctccagaaaggagtcggtctctggcctgccctgcccgcctgctctttttcccaaacaaacggatcagacgaataaacgctcataaatacctctgggcttagataagagcgatgaggcgctattttctttcatgcccgactccaggcgcccaggcccgcctgtagtggctccatctccagacaagca

SEQ ID NO: 734994 - DNA, 250 bp, Homo sapiens
cacacccacaccaggcctcaggattttgtgttgatcaagttccaaggaaaaggaacatctcagccgggcgtggtggttcacgcctggaatcccagcacttgaggccaggagttccagagcagcctgggcaacgcagtgagagaccccatctctacaaaaaaaaaaaagaaagaaagaaaatgagagatccaggtttaaaaattcataaacaccacaaggaaacaatacactatgagacccagcagaagca

SEQ ID NO: 734995 - DNA, 250 bp, Homo sapiens
ccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgcccc

SEQ ID NO: 734996 - DNA, 250 bp, Homo sapiens
gagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaac

SEQ ID NO: 734997 - DNA, 250 bp, Homo sapiens
tggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactg

SEQ ID NO: 734998 - DNA, 250 bp, Homo sapiens
gccatcaactttcagagctatcatgagccaacctcaccccacagggcctcagtcgccaccatgtgggcctctccagtgcaaaccaccgagcattccaccatgaccggtcacagctacaaatccagagaccatcaatcctgctagagtgcagggtggcaagcacccaagggtggctgaccaagactgcagagtctcctccatcttcaggtccattcagcctcctggcatttaactaccagcatccagtggt

SEQ ID NO: 734999 - DNA, 250 bp, Homo sapiens
gctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttc

SEQ ID NO: 735000 - DNA, 250 bp, Homo sapiens
gctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttact

SEQ ID NO: 735001 - DNA, 250 bp, Homo sapiens
gggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccg

SEQ ID NO: 735002 - DNA, 250 bp, Homo sapiens
atctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgagaaccaaggttttgaaatcccatca

SEQ ID NO: 735003 - DNA, 250 bp, Homo sapiens
ttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagt

SEQ ID NO: 735004 - DNA, 250 bp, Homo sapiens
aggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccc

SEQ ID NO: 735005 - DNA, 250 bp, Homo sapiens
aggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcacctt

SEQ ID NO: 735006 - DNA, 250 bp, Homo sapiens
aatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggtt

SEQ ID NO: 735007 - DNA, 250 bp, Homo sapiens
aacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaa

SEQ ID NO: 735008 - DNA, 250 bp, Homo sapiens
accgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgcc

SEQ ID NO: 735009 - DNA, 250 bp, Homo sapiens
taggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttggcttgacttgctctttgtcacagactgcataagttgtcagccttgactatctttt

SEQ ID NO: 735010 - DNA, 250 bp, Homo sapiens
actcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagc

SEQ ID NO: 735011 - DNA, 250 bp, Homo sapiens
ggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagccc

SEQ ID NO: 735012 - DNA, 250 bp, Homo sapiens
cagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaaaaaaaacccaaaaaaaaaaaaacaaaaacg

SEQ ID NO: 735013 - DNA, 250 bp, Homo sapiens
tgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtata

SEQ ID NO: 735014 - DNA, 250 bp, Homo sapiens
gtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagccccctt

SEQ ID NO: 735015 - DNA, 250 bp, Homo sapiens
gactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgc

SEQ ID NO: 735016 - DNA, 250 bp, Homo sapiens
aatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaag

SEQ ID NO: 735017 - DNA, 250 bp, Homo sapiens
tgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgct

SEQ ID NO: 735018 - DNA, 250 bp, Homo sapiens
cactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacct

SEQ ID NO: 735019 - DNA, 250 bp, Homo sapiens
tatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccc

SEQ ID NO: 735020 - DNA, 250 bp, Homo sapiens
gactatccctgtcatactgttgccactgatattctgaaagcaccaccagaggatgacaatcgagaaattgccacatggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactc

SEQ ID NO: 735021 - DNA, 250 bp, Homo sapiens
ctctttcatatatgggaaaatttaaaaagttactctcatagaagtagagagtaaaatagaggctactagaggctgggaagggtagaggggcaagggtcatagggaaaagagagttaacggatacaaattacagctagaaagatgggaagagtgaattccagtgttctaaagcagggtaggtgactacagttaatgattatttattgtctacttattgtatattattgtatattttcaaatattgtatatt

SEQ ID NO: 735022 - DNA, 250 bp, Homo sapiens
agaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaaaaaaaaaaaacaaaacaaccaaaagggggcgggcgaaaaaatcccgggggcccacatccgacccc

SEQ ID NO: 735023 - DNA, 250 bp, Homo sapiens
tttatcctgccgccgctttcagactccctggccaccctgtccactcccatggcctccacattgaagcttctaagcccagccctgcgacctacggccgaacctctccctggacgtcccagggtgctccctggtcagcaagtccaaaacagaactctcgcttcccaccttctctcctaagtgatcctctttatcccccttccgtgtctcactttcccaagtccttgtattactgggtctgggtgtgcaagga

SEQ ID NO: 735024 - DNA, 250 bp, Homo sapiens
catggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtcaacacaaaca

SEQ ID NO: 735025 - DNA, 250 bp, Homo sapiens
gtcctttagcaatcaatgcatttaatctttcctggatggctgccatgtggactgcatgcaaaatggaccattatgtggctactactgaatttctttggtctgtaccctgtagccctcaaagtctggacatttctttcgcaatacatccagaggatgcaaaagctctatgggacagtgtccacaaaacacctggggaggttacccaggaagaagttgacctattcatggattgcctttattcacatttcca

SEQ ID NO: 735026 - DNA, 250 bp, Homo sapiens
ttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacct

SEQ ID NO: 735027 - DNA, 250 bp, Homo sapiens
tgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaa

SEQ ID NO: 735028 - DNA, 250 bp, Homo sapiens
cgcaacagccatgtcaccgctgttcgctctcgccgaggaacaagtcggtcaggaagcccgcgcgcaacagccatgccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaatt

SEQ ID NO: 735029 - DNA, 250 bp, Homo sapiens
ctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgt

SEQ ID NO: 735030 - DNA, 250 bp, Homo sapiens
ggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtg

SEQ ID NO: 735031 - DNA, 250 bp, Homo sapiens
ctcctttcatcctgtgctctgccctccccgggagcctcagagtttgcttctggctggcggcaagggaaagggacgatggagaaggcacggctgcttcttacctgccttgctcttaactgacacacatcactcctgctcacgtcctcttggccactggtagtcatgtggccccacctggatgcagaggaggccaggatgtgcagtctccacatagtggcttcccagcaacaacttttgacttagatggggg

SEQ ID NO: 735032 - DNA, 250 bp, Homo sapiens
gacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgt

SEQ ID NO: 735033 - DNA, 250 bp, Homo sapiens
caaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacggg

SEQ ID NO: 735034 - DNA, 250 bp, Homo sapiens
tgttttccaaaaacttgtagaaggttgtgaaaaaactactaggatcacgcggcatgtattgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttacttgatgttgataacatcacaataaattatgg

SEQ ID NO: 735035 - DNA, 250 bp, Homo sapiens
acagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctccttt

SEQ ID NO: 735036 - DNA, 250 bp, Homo sapiens
tgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggt

SEQ ID NO: 735037 - DNA, 250 bp, Homo sapiens
gtccccagacagtcccggtgtgcacacttccctgcttctgttcatgatgttctctgaacctgggatcacctttccccttcctcttacctgcccgatcctacttgtcctcccagattcagttttctgaagctcagagggacaccttgtattgctggatgataaaaacaggagcaaagtgatgaagtgctgacaaggcaacaatagaacatgagagattcactgctgtgtaggaagagatcttcggtgacca

SEQ ID NO: 735038 - DNA, 250 bp, Homo sapiens
acaacagtgagctgggacggagacaagctccagtgtgtgcagaagggtgagaaggaggggcgtggctggacccagtggatcgagggtgatgagctgcacctggagatgagagtggaaggtgtggtctgcaagcaagtattcaagaaggtgcagtgaggcccaggcagacaaccttgtcccaaggaatcagcaggatgtgtgggccaggatccccctctttgcacagcatgaggcaaaaatgtccagccac

SEQ ID NO: 735039 - DNA, 250 bp, Homo sapiens
gtgagtgtctctagggtgatacgtgggtgagaaaggtcctggtccgcgccagagcccagcgcgcctcgtcgccattcctggtccgcgccagagcccagcgcgcctcgtcgccatctgtcaagatcaagaaaaataaggacaacgtgaagtttaaagttcgatgcagcagatacctttacaccctggtcatcactgacaaagagaaggcagagaaactgaagcagtccctgccccccgtttggcagtgaag

SEQ ID NO: 735040 - DNA, 250 bp, Homo sapiens
aagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggag

SEQ ID NO: 735041 - DNA, 250 bp, Homo sapiens
gttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacatta

SEQ ID NO: 735042 - DNA, 250 bp, Homo sapiens
ccaattattttttgtctcttctactagaatgttagaattacaagaaagagatcctgtctgttttattcactattgtatcttcagtactggaacagtacgtggcacttagatattcaattattttttactgaatgtttacaccactcctgagaagaataagcgtaagcgaaagaaggtgaagctggctgtcctgaaatactgtaaggtggatgagaatggcaaaataagtcgccttcatctagagtgctct

SEQ ID NO: 735043 - DNA, 250 bp, Homo sapiens
gcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaa

SEQ ID NO: 735044 - DNA, 250 bp, Homo sapiens
ttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaata

SEQ ID NO: 735045 - DNA, 250 bp, Homo sapiens
gaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctg

SEQ ID NO: 735046 - DNA, 250 bp, Homo sapiens
tggcctggccatctccctccccagaaacagtgtgcatgggttattttggagtgtaggtgacttgtttactcattgaagcagatttctgcttccttttatttttataggaatagaggaagaaatgtcagatgcgtgcccagctcttcaccccccaatctcttggtggggaggggtgtacctaaatatttatcatatccttgcccttgagtgcttgttagagagaaagagaactactaaggaaaataatatt

SEQ ID NO: 735047 - DNA, 250 bp, Homo sapiens
ttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgccca

SEQ ID NO: 735048 - DNA, 250 bp, Homo sapiens
cattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtg

SEQ ID NO: 735049 - DNA, 250 bp, Homo sapiens
tcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagg

SEQ ID NO: 735050 - DNA, 250 bp, Homo sapiens
ccctcatccccattatgggagctacagcttagaatcaatttcagctctaatcccttagccttacaatcaccagtatctgcctttgacgtcctctgagacctgctctccttcgtgcagggagtgccatgccctcgtgggtgacagcgtgctgacagagtggactgtgaatattcttcaagtacttgtggtcctgggtcatcaggggttgcattctacccagttacagagggtttcccatcgaggaggccag

SEQ ID NO: 735051 - DNA, 250 bp, Homo sapiens
aagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggt

SEQ ID NO: 735052 - DNA, 250 bp, Homo sapiens
aatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaa

SEQ ID NO: 735053 - DNA, 250 bp, Homo sapiens
taacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcc

SEQ ID NO: 735054 - DNA, 250 bp, Homo sapiens
ccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgtccttgctggtgcagacgaagcggcgggctctggagaagattgaccttaagttcattgacac

SEQ ID NO: 735055 - DNA, 250 bp, Homo sapiens
acaagtactaccgagtcaatcttcgcacacggcgagtggacactgtggaccctccctacccacgctccatcgctcagtactggctgggctgcccagctcctggccatctgtaggagtcagagcccacatggccgggccctacaagtactaccgagtcaatcttcgcacacggcgagtggacactgtggaccctccctacccacgctccatcgctcagtactggctgggctgcccagctcctggccatctg

SEQ ID NO: 735056 - DNA, 250 bp, Homo sapiens
cgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgac

SEQ ID NO: 735057 - DNA, 250 bp, Homo sapiens
gtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtc

SEQ ID NO: 735058 - DNA, 250 bp, Homo sapiens
tgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctagggacaggaagatggttggcgacgtgaccggggcccaggcctatgcctccaccgccaagtgcctgaacatctgggccctgattctgggcatcctcatgaccat

SEQ ID NO: 735059 - DNA, 250 bp, Homo sapiens
cgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagt

SEQ ID NO: 735060 - DNA, 250 bp, Homo sapiens
ggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgag

SEQ ID NO: 735061 - DNA, 250 bp, Homo sapiens
gatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggcc

SEQ ID NO: 735062 - DNA, 250 bp, Homo sapiens
gtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacaca

SEQ ID NO: 735063 - DNA, 250 bp, Homo sapiens
ggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagca

SEQ ID NO: 735064 - DNA, 250 bp, Homo sapiens
ctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaa

SEQ ID NO: 735065 - DNA, 250 bp, Homo sapiens
atggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttcc

SEQ ID NO: 735066 - DNA, 250 bp, Homo sapiens
gcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaa

SEQ ID NO: 735067 - DNA, 250 bp, Homo sapiens
aagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccata

SEQ ID NO: 735068 - DNA, 250 bp, Homo sapiens
cgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataag

SEQ ID NO: 735069 - DNA, 250 bp, Homo sapiens
atggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaa

SEQ ID NO: 735070 - DNA, 250 bp, Homo sapiens
ggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgc

SEQ ID NO: 735071 - DNA, 250 bp, Homo sapiens
ggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacat

SEQ ID NO: 735072 - DNA, 250 bp, Homo sapiens
agggatggttcctgagcggctgcccccatggctccagcgctacgtggacaaagtgtcaaacctcagcctctttggaggcctcccagctaaccatgtcctcgtgaaccagtatctgcctggggagggcatcatgccccacgaggacggaccactgtactacccgactgtcagcaccatcagcctgggctcccacaccgtgctggacttctacgagccgcggcggccagaggacgatgaccctacagaacag

SEQ ID NO: 735073 - DNA, 250 bp, Homo sapiens
acatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgag

SEQ ID NO: 735074 - DNA, 250 bp, Homo sapiens
aggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatga

SEQ ID NO: 735075 - DNA, 250 bp, Homo sapiens
gtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctc

SEQ ID NO: 735076 - DNA, 250 bp, Homo sapiens
gcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaa

SEQ ID NO: 735077 - DNA, 250 bp, Homo sapiens
gcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgaggg

SEQ ID NO: 735078 - DNA, 250 bp, Homo sapiens
gcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccc

SEQ ID NO: 735079 - DNA, 250 bp, Homo sapiens
ggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctt

SEQ ID NO: 735080 - DNA, 250 bp, Homo sapiens
cccagcggccagatcggcttcatgctgtgcagcaagaacccgagcacgaacttccaggagccggtgcagccgctgacacagcagcaggtggcgcagatgcagctgaagtactacaactccgacgtgcaccgcgccgcctttgtgctgcccgagtttgcccgcaaggccctgaatgatgtgagctgagcccaggcgccaccactgatgccacccaggacctcggaccttggagcctgcggggtgcctcggc

SEQ ID NO: 735081 - DNA, 250 bp, Homo sapiens
aacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaat

SEQ ID NO: 735082 - DNA, 250 bp, Homo sapiens
tgccgctgacatccggttcgtctacacccccgccatggagccttaggggatgccgctgacatccggttcgtctacacccccgccatggaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcaca

SEQ ID NO: 735083 - DNA, 250 bp, Homo sapiens
acgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggc

SEQ ID NO: 735084 - DNA, 250 bp, Homo sapiens
tggcatatgaaaatttattactacagtgttttcaccattaatatttatgatcttggtctttccttcttgcctttgtatagggccaaaagagaaacattggctactttgacaaccttaaagcggactccaggaatatcaccaacagcatgacctttgcgaccaaatccagcaaccagaacttcatcattttcctggaataaaataagaagtttatttctggtgttggtggcgatcacaaaaatactttcat

SEQ ID NO: 735085 - DNA, 250 bp, Homo sapiens
caagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaa

SEQ ID NO: 735086 - DNA, 250 bp, Homo sapiens
gctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcact

SEQ ID NO: 735087 - DNA, 250 bp, Homo sapiens
cttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagcc

SEQ ID NO: 735088 - DNA, 250 bp, Homo sapiens
tgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatg

SEQ ID NO: 735089 - DNA, 250 bp, Homo sapiens
ctacaacagacacatcagatgacactccgggcaaataaatgattttcactgaggacttactggttttaataataggtcctggtgtagagaagtccctcaacctattgtgcaacgagttttgagaagcgggtaagctgtatgttttgtggttttgtttcataaattcatctacaggaagaccaatattgactgaatgaagctttcatttaaagagctaaaatatgctttgtgtttttatatgtggatacta

SEQ ID NO: 735090 - DNA, 250 bp, Homo sapiens
gcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacag

SEQ ID NO: 735091 - DNA, 250 bp, Homo sapiens
tgcctggtaattttcccggaggaatgcctggaatgggagggggcatgcctggaatggctggaatgcctggactcaatgaaattcttagtgatccagaggttcttgcagccatgcaggtggctttcctgggggaatgcctggtaattttcccggaggaatgcctggaatgggagggggcatgcctggaatggctggaatgcctggactcaatgaaattcttagtgatccagaggttcttgcagccatgcag

SEQ ID NO: 735092 - DNA, 250 bp, Homo sapiens
gccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccata

SEQ ID NO: 735093 - DNA, 250 bp, Homo sapiens
agagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatc

SEQ ID NO: 735094 - DNA, 250 bp, Homo sapiens
ggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgat

SEQ ID NO: 735095 - DNA, 250 bp, Homo sapiens
ctcccagttcgcctcgtcgccatgcctcggaaaattgaggaaatcaaggattttctgctcacagtccgatgaaaggatgccaaatccgtcaagatcaagaaaaataaggacaatgtgaagtttaaagtttgacacagcaaatacctttacaccctggtcatcactgacaaagagaaggcagataaactgtagtccctgccccctggtttggcagtgaaggaactaaaatgaaccagacacactgatttgt

SEQ ID NO: 735096 - DNA, 19015 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcc

SEQ ID NO: 735097 - DNA, 3418 bp, Homo sapiens
tcccaagatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcc

SEQ ID NO: 735098 - DNA, 18895 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttgtaggtattttttctgccttagagctcttatgcttttctgaaataactgccttttgtcttgaactacagcttctggattaggagtgtgaaagaatggttctgtctttgtaagcgtgtttcacattttatgtgtcatgtcttttgctgaagtcccatatcagaagaagacctaaaacatatattcagagcagtcagaggtcattgataggtttccttcctaaaaacctgacttgcaatgttgaactaaaagaggccttcctaggttgcctagctaaaccagattatggatccctaatttattcttgccagattgaatgatgagctggtccttacagcagactttgtgacccctgcagcactgcctcctggtcctcacagctatccctttttctgtgcctttgctggggaaaaacagtaaccatcacattttgcacgcatctggcttgcttccacttgacactcttgggtcacgtgcagatgactgtgccagtcagtggaaagtctatagtgatggcaccatgactctctctgcctctggaacccttaactgggggggaaggggacagtgggaaagaaagtttcaggcgttgatagcagctctcctccctctgccctggtcatgtctcccttttctggcctctttcaatcctgtttatgccttgcccttcctaaccaggcctttgctgtgttgcttatcttctcacattccatagttgtgtgtccaagtagaggtctgttacggcttttgcagaatggatccttgctcagggaaagtattcacaccatctggcacagaggtccctttcaacctgaggatgaaagcctgcattatattcttaagcaaagccttccctgacccccagtgcccatgtaagctcaccacagcacttaccacctagaatttcaatggtggttacgtctctctccactacgctgtgaacagcttgaggatagggaatttgccaactctgttatggtccttgcacccagaataggacgttcttgcccaaacccaccattcttgggatctcaagttcataagcgtcctgttgaaggccctcattcttatagttagccctggggagtccagttctgttaagatgctttcatcaaaaacttcacagttgctcttctgtgctctactctgtagttgggccacactgagcagattctttggtagaattttcaacttgagactaacacaagtatttccttttctgttcag

SEQ ID NO: 735099 - DNA, 19291 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcc

SEQ ID NO: 735100 - DNA, 19333 bp, Homo sapiens
  misc_feature (19333)..(19333): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaaaaaaaaaaaaaaaaaaaaaaaaaacaaaaaaaagaacaaaataaaaaaaaagaaaacaacaaaaaaaaaaacaacaaaaaacaaaagagagggaggaggcgcaacaagcacaacgaagcactaccccgggagggggcacgccgcacacagaacgccggagcggcacgcccggaccccactatctagaaacgacaaagcgtgtgcccacacaaaacaaaagtaaaaagagcgcagacttatcaatcagacacacgccaagcgacgagacgcggccgcagatcctcaacaaacacagcacactgaatagcaaggtggagagaaacacaacctggtggctgacgcagcgacacacatcctgcgaaggaaaagacgagacactcacactaccatgggagagtggaggagcaaaacaacacacaggcgagaagaacaacaaaaacccagccacaccagcaaacataaacacgccaccatgacaacggcgacaacacaacaacgaccacgtctcaagcccgagtcactaactgagcacagacaacaccgcacacacaactacaatcagccgcggaacaaaggacaactaactacgaacgacaaccgactgatcagagcagagacaaacactcaactccaaccgagggagcgatcaaagaacaaataaggan

SEQ ID NO: 735101 - DNA, 18822 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaacaaaaatgctagtaaaatgataatgtaccgaaattggagaaatattcaattgtaactcacttttaaaaataataaaaccttagggggggtcccggtacaaatttccccttatagagggcggttttaaatttaattggcggcttttaacaacgtt

SEQ ID NO: 735102 - DNA, 18612 bp, Homo sapiens
  misc_feature (18536)..(18536): n is a, c, g, or t
  misc_feature (18547)..(18547): n is a, c, g, or t
  misc_feature (18552)..(18552): n is a, c, g, or t
  misc_feature (18555)..(18555): n is a, c, g, or t
  misc_feature (18557)..(18557): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatggggnccccgggtggntaaanatngngccggtttaacccggggggaattcggggtaccacacaaaaccattgggaggcaca

SEQ ID NO: 735103 - DNA, 18781 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttgtaggtattttttctgccttagagctcttatgcttttctgaaataactgccttttgtcttgaactacagcttctggattaggagtgtgaaagaatggttctgtctttgtaagcgtgtttcacattttatgtgtcatgtcttttgctgaagtcccatatcagaagaagacctaaaacatatattcagagcagtcagaggtcattgataggtttccttcctaaaaacctgacttgcaatgttgaactaaaagaggccttcctaggttgcctagctaaaccagattatggatccctaatttattcttgccagattgaatgatgagctggtccttacagcagactttgtgacccctgcagcactgcctcctggtcctcacagctatccctttttctgtgcctttgctggggaaaaacagtaaccatcacattttgcacgcatctggcttgcttccacttgacactcttgggtcacgtgcagatgactgtgccagtcagtggaaagtctatagtgatggcaccatgactctctctgcctctggaacccttaactgggggggaaggggacagtgggaaagaaagtttcaggcgttgatagcagctctcctccctctgccctggtcatgtctcccttttctggcctctttcaatcctgtttatgccttgcccttcctaaccaggcctttgctgtgttgcttatcttctcacattccatagttgtgtgtccaagtagaggtctgttacggcttttgcagaatggatccttgctcagggaaagtattcacaccatctggcacagaggtccctttcaacctgaggatgaaagcctgcattatattcttaagcaaagccttccctgacccccagtgcccatgtaagctcaccacagcacttaccacctagaatttcaatggtggttacgtctctctccactacgctgtgaacagcttgaggatagggaatttgccaactctgttatggtccttgcacccagaataggacgttcttgcccaaacccaccattcttgggatctcaagttcataagcgtcctgttgaaggccctcattcttatagttagccctggggagtccagttctgttaagatgctttcatcaaaaacttcacagttgctcttctgtgctctactctgtagttgggccacactgagcagattctttggtagaattttcaacttgagactaacacaagtatttccttttctgttcag

SEQ ID NO: 735104 - DNA, 19177 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcc

SEQ ID NO: 735105 - DNA, 19219 bp, Homo sapiens
  misc_feature (19219)..(19219): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaaaaaaaaaaaaaaaaaaaaaaaaaacaaaaaaaagaacaaaataaaaaaaaagaaaacaacaaaaaaaaaaacaacaaaaaacaaaagagagggaggaggcgcaacaagcacaacgaagcactaccccgggagggggcacgccgcacacagaacgccggagcggcacgcccggaccccactatctagaaacgacaaagcgtgtgcccacacaaaacaaaagtaaaaagagcgcagacttatcaatcagacacacgccaagcgacgagacgcggccgcagatcctcaacaaacacagcacactgaatagcaaggtggagagaaacacaacctggtggctgacgcagcgacacacatcctgcgaaggaaaagacgagacactcacactaccatgggagagtggaggagcaaaacaacacacaggcgagaagaacaacaaaaacccagccacaccagcaaacataaacacgccaccatgacaacggcgacaacacaacaacgaccacgtctcaagcccgagtcactaactgagcacagacaacaccgcacacacaactacaatcagccgcggaacaaaggacaactaactacgaacgacaaccgactgatcagagcagagacaaacactcaactccaaccgagggagcgatcaaagaacaaataaggan

SEQ ID NO: 735106 - DNA, 18708 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaacaaaaatgctagtaaaatgataatgtaccgaaattggagaaatattcaattgtaactcacttttaaaaataataaaaccttagggggggtcccggtacaaatttccccttatagagggcggttttaaatttaattggcggcttttaacaacgtt

SEQ ID NO: 735107 - DNA, 18498 bp, Homo sapiens
  misc_feature (18422)..(18422): n is a, c, g, or t
  misc_feature (18433)..(18433): n is a, c, g, or t
  misc_feature (18438)..(18438): n is a, c, g, or t
  misc_feature (18441)..(18441): n is a, c, g, or t
  misc_feature (18443)..(18443): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatggggnccccgggtggntaaanatngngccggtttaacccggggggaattcggggtaccacacaaaaccattgggaggcaca

SEQ ID NO: 735108 - DNA, 17317 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttggtccagatatgagcattgaattgtatcttcttgttaaaacactcagcataaaaggctgaaatgggtggatgatgggaaacctgctcagccacaaatgttagtcgagc

SEQ ID NO: 735109 - DNA, 16853 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgcttcagtttcgtcgacgcggccgc
